United States Patent
Davicioni

(10) Patent No.: US 10,865,452 B2
(45) Date of Patent: Dec. 15, 2020

(54) SYSTEMS AND METHODS FOR EXPRESSION-BASED DISCRIMINATION OF DISTINCT CLINICAL DISEASE STATES IN PROSTATE CANCER

(71) Applicant: DECIPHER BIOSCIENCES, INC., San Diego, CA (US)

(72) Inventor: Elai Davicioni, La Jolla, CA (US)

(73) Assignee: DECIPHER BIOSCIENCES, INC., San Diego, CA (US)

(*) Notice: Subject to any disclaimer, the term of this patent is extended or adjusted under 35 U.S.C. 154(b) by 0 days.

(21) Appl. No.: 15/092,468

(22) Filed: Apr. 6, 2016

(65) Prior Publication Data

US 2017/0191133 A1 Jul. 6, 2017

Related U.S. Application Data

(63) Continuation of application No. 12/994,408, filed as application No. PCT/CA2009/000694 on May 28, 2009, now abandoned.

(60) Provisional application No. 61/056,827, filed on May 28, 2008.

(51) Int. Cl.
*C12Q 1/6886* (2018.01)
*C12N 15/113* (2010.01)

(52) U.S. Cl.
CPC ...... *C12Q 1/6886* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| | | |
|---|---|---|
| 3,645,691 A | 2/1972 | Guenter et al. |
| 3,687,808 A | 8/1972 | Thomas, Jr. et al. |
| 4,323,546 A | 4/1982 | Crockfor et al. |
| 4,683,195 A | 7/1987 | Mullis et al. |
| 4,683,202 A | 7/1987 | Mullis et al. |
| 4,800,159 A | 1/1989 | Mullis et al. |
| 4,965,188 A | 10/1990 | Mullis et al. |
| 5,130,238 A | 7/1992 | Malek et al. |
| 5,143,854 A | 9/1992 | Pinung et al. |
| 5,225,326 A | 7/1993 | Bresser et al. |
| 5,270,184 A | 12/1993 | Walker et al. |
| 5,283,174 A | 2/1994 | Arnold et al. |
| 5,288,514 A | 2/1994 | Ellman |
| 5,384,261 A | 1/1995 | Winkle et al. |
| 5,399,491 A | 3/1995 | Kacian et al. |
| 5,455,166 A | 10/1995 | Walker |
| 5,480,784 A | 1/1996 | Kacian et al. |
| 5,494,810 A | 2/1996 | Barany et al. |
| 5,538,848 A | 7/1996 | Livak et al. |
| 5,545,524 A | 8/1996 | Trent et al. |
| 5,677,195 A | 10/1997 | Winkler et al. |
| 5,705,365 A | 1/1998 | Ryder et al. |
| 5,710,029 A | 1/1998 | Ryder et al. |
| 5,711,029 A | 1/1998 | Ryder et al. |
| 5,744,305 A | 4/1998 | Fodor et al. |
| 5,814,447 A | 9/1998 | Ishiguro et al. |
| 5,824,518 A | 10/1998 | Kacian et al. |
| 5,830,711 A | 11/1998 | Barany et al. |
| 5,846,717 A | 12/1998 | Brow et al. |
| 5,854,033 A | 12/1998 | Lizardi |
| 5,854,206 A | 12/1998 | Twardzik et al. |
| 5,888,779 A | 3/1999 | Kacian et al. |
| 5,925,517 A | 7/1999 | Tyagi et al. |
| 5,928,862 A | 7/1999 | Morrison |
| 5,965,360 A | 10/1999 | Zain et al. |
| 5,985,557 A | 11/1999 | Prudent et al. |
| 5,989,815 A | 11/1999 | Skolnick et al. |
| 5,994,069 A | 11/1999 | Hall et al. |
| 6,001,567 A | 12/1999 | Brow et al. |
| 6,022,692 A | 2/2000 | Coulie et al. |
| 6,027,887 A | 2/2000 | Zavada et al. |

(Continued)

FOREIGN PATENT DOCUMENTS

| | | |
|---|---|---|
| EP | 0 684 315 | 11/1995 |
| EP | 1 409 727 | 11/2005 |

(Continued)

OTHER PUBLICATIONS

US 5,962,233 A, 10/1999, Livak et al. (withdrawn)
Australian Examination Report dated Oct. 4, 2016, regarding AU 2014274499.
Canadian Examination Report dated Mar. 17, 2017, regarding CA 2,725,978.
Landers et al.: "Use of multiple biomarkers for a molecular diagnosis of prostate cancer"; Int. J. Cancer, 114, May 10, 2005, pp. 950-956.
Abdueva et al., "Quantitative Expression Profiling in Formalin-Fixed ParaffinEmbedded Samples by Affymetrix Microarrays," Journal of Molecular Diagnostics, vol. 12, No. 4, Jul. 2010, pp. 409-417.
Affymetrix: "GeneChip exon array system for human, mouse, and rat," Internet Citation, [Online] Jan. 25, 2012 [Retrieved from the Internet] Intp://www.biainformatics.atickland.aciaz/workshops/10_March_20111Exon_EOST_Datasheet.pdf, 8 pages.

(Continued)

Primary Examiner — Channing S Mahatan
(74) Attorney, Agent, or Firm — Knobbe, Martens, Olson & Bear, LLP

(57) ABSTRACT

A system for expression-based discrimination of distinct clinical disease states in prostate cancer is provided that is based on the identification of sets of gene transcripts, which are characterized in that changes in expression of each gene transcript within a set of gene transcripts can be correlated with recurrent or non-recurrent prostate cancer. The Prostate Cancer Prognostic system provides for sets of "prostate cancer prognostic" target sequences and further provides for combinations of polynucleotide probes and primers derived there from. These combinations of polynucleotide probes can be provided in solution or as an array. The combination of probes and the arrays can be used for diagnosis. The invention further provides further methods of classifying prostate cancer tissue.

14 Claims, 9 Drawing Sheets

Specification includes a Sequence Listing.

(56) References Cited

U.S. PATENT DOCUMENTS

| | | |
|---|---|---|
| 6,034,218 A | 3/2000 | Reed et al. |
| 6,090,543 A | 7/2000 | Prudent et al. |
| 6,121,489 A | 9/2000 | Dorner et al. |
| 6,136,182 A | 10/2000 | Dolan et al. |
| 6,150,097 A | 11/2000 | Tyagi et al. |
| 6,198,107 B1 | 3/2001 | Seville |
| 6,218,523 B1 | 4/2001 | French |
| 6,225,051 B1 | 5/2001 | Sugiyama et al. |
| 6,251,639 B1 | 6/2001 | Kurn |
| 6,262,245 B1 | 7/2001 | Xu et al. |
| 6,268,142 B1 | 7/2001 | Duff et al. |
| 6,303,305 B1 | 10/2001 | Wittwer et al. |
| 6,410,278 B1 | 6/2002 | Notomi et al. |
| 6,436,642 B1 | 8/2002 | Gould-Rothberg et al. |
| 6,541,205 B1 | 4/2003 | Yokoyama et al. |
| 6,573,043 B1 | 6/2003 | Cohen et al. |
| 6,630,358 B1 | 10/2003 | Wagner et al. |
| 6,723,506 B2 | 4/2004 | Fletcher et al. |
| 6,828,429 B1 | 12/2004 | Srivastava et al. |
| 7,008,765 B1 | 3/2006 | Bussemakers et al. |
| 7,186,514 B2 | 3/2007 | Zavada et al. |
| 7,211,390 B2 | 5/2007 | Rothberg et al. |
| 7,244,559 B2 | 7/2007 | Rothberg et al. |
| 7,264,929 B2 | 9/2007 | Rothberg et al. |
| 7,280,922 B2 | 10/2007 | Mei et al. |
| 7,300,788 B2 | 11/2007 | Matsuzaki et al. |
| 7,319,011 B2 | 1/2008 | Riggins et al. |
| 7,323,305 B2 | 1/2008 | Leamon et al. |
| 7,335,762 B2 | 2/2008 | Rothberg et al. |
| 7,358,061 B2 | 4/2008 | Yamamoto et al. |
| 7,361,488 B2 | 4/2008 | Fan et al. |
| 7,378,233 B2 | 5/2008 | Sidransky et al. |
| 7,407,755 B2 | 8/2008 | Lubinski et al. |
| 7,541,169 B2 | 6/2009 | Freimuth et al. |
| 7,598,052 B2 | 10/2009 | Giordano et al. |
| 7,662,553 B2 | 2/2010 | Lenz et al. |
| 7,767,391 B2 | 8/2010 | Scott et al. |
| 7,901,881 B2 | 3/2011 | Libutti et al. |
| 7,901,888 B2 | 3/2011 | Kebebew |
| 7,914,988 B1 | 3/2011 | Chudin et al. |
| 7,927,826 B2 | 4/2011 | Riggins et al. |
| 8,008,009 B2 | 8/2011 | Choquet-Kastylevsky et al. |
| 8,202,692 B2 | 6/2012 | Giordano et al. |
| 8,273,539 B2 | 9/2012 | Klee et al. |
| 8,293,880 B2 | 10/2012 | Cote et al. |
| 8,299,233 B2 | 10/2012 | Andre et al. |
| 8,338,109 B2 | 12/2012 | Vasmatzis et al. |
| 8,354,228 B2 | 1/2013 | Ron |
| 8,465,914 B2 | 6/2013 | Brown et al. |
| 8,541,170 B2 | 9/2013 | Kennedy et al. |
| 8,568,971 B2 | 10/2013 | Brown et al. |
| 8,669,057 B2 | 3/2014 | Kennedy et al. |
| 8,802,599 B2 | 8/2014 | Aharonov et al. |
| 8,828,656 B2 | 9/2014 | Bullerdiek et al. |
| 8,877,445 B2 | 11/2014 | Shackney |
| 8,945,829 B2 | 2/2015 | Keutgen et al. |
| 9,040,286 B2 | 5/2015 | Zon et al. |
| 9,074,258 B2 | 7/2015 | Davicion et al. |
| 9,096,906 B2 | 8/2015 | Aharonov et al. |
| 9,157,123 B2 | 10/2015 | Xing |
| 9,175,352 B2 | 11/2015 | Keutgen et al. |
| 9,206,481 B2 | 12/2015 | Srivastava et al. |
| 9,206,482 B2 | 12/2015 | Davicioni et al. |
| 9,234,244 B2 | 1/2016 | Zeiger et al. |
| 9,435,812 B2 | 9/2016 | Pestano et al. |
| 9,495,515 B1 | 11/2016 | Giulia et al. |
| 9,534,249 B2 | 1/2017 | Vasmatzis et al. |
| 9,587,279 B2 | 3/2017 | Fahey, III et al. |
| 9,617,604 B2 | 4/2017 | Davicion et al. |
| 9,708,667 B2 | 7/2017 | Yanai et al. |
| 9,714,452 B2 | 7/2017 | Davicioni et al. |
| 9,856,537 B2 | 1/2018 | Kennedy et al. |
| 9,994,907 B2 | 6/2018 | Davicioni et al. |
| 10,114,924 B2 | 10/2018 | Kennedy et al. |
| 10,407,731 B2 | 9/2019 | Klee et al. |
| 10,422,009 B2 | 9/2019 | Davicioni et al. |
| 10,494,677 B2 | 12/2019 | Vasmatzis et al. |
| 2001/0051344 A1 | 12/2001 | Shalon et al. |
| 2002/0076735 A1 | 6/2002 | Williams et al. |
| 2002/0090633 A1 | 7/2002 | Becker et al. |
| 2002/0119463 A1 | 8/2002 | Fads |
| 2002/0168638 A1 | 11/2002 | Schlegel et al. |
| 2002/0169137 A1 | 11/2002 | Reiner et al. |
| 2002/0182586 A1 | 12/2002 | Morris et al. |
| 2003/0119168 A1 | 6/2003 | Madison et al. |
| 2003/0152980 A1 | 8/2003 | Golub et al. |
| 2003/0175736 A1 | 9/2003 | Chinnaiyan et al. |
| 2003/0185830 A1 | 10/2003 | Xu et al. |
| 2003/0186248 A1 | 10/2003 | Erlander et al. |
| 2003/0190602 A1 | 10/2003 | Pressman et al. |
| 2003/0194734 A1 | 10/2003 | Jatkoe |
| 2003/0224399 A1 | 12/2003 | Reed et al. |
| 2003/0235820 A1 | 12/2003 | Mack |
| 2004/0009481 A1 | 1/2004 | Schlegel et al. |
| 2004/0018493 A1 | 1/2004 | Anastasio et al. |
| 2004/0019466 A1 | 1/2004 | Minor et al. |
| 2004/0029114 A1 | 2/2004 | Mack et al. |
| 2004/0058378 A1 | 3/2004 | Kong et al. |
| 2004/0259086 A1 | 12/2004 | Schlegel et al. |
| 2005/0042222 A1 | 2/2005 | Yamamoto et al. |
| 2005/0042638 A1 | 2/2005 | Arnold et al. |
| 2005/0048533 A1 | 3/2005 | Sidransky et al. |
| 2005/0064455 A1 | 3/2005 | Baker et al. |
| 2005/0118625 A1 | 6/2005 | Mounts |
| 2005/0137805 A1 | 6/2005 | Lewin et al. |
| 2005/0202442 A1 | 9/2005 | Morris et al. |
| 2005/0227917 A1 | 10/2005 | Williams et al. |
| 2005/0240357 A1 | 10/2005 | Minor |
| 2005/0250125 A1 | 11/2005 | Novakoff |
| 2005/0260646 A1 | 11/2005 | Baker et al. |
| 2005/0266443 A1 | 12/2005 | Croce et al. |
| 2005/0266459 A1 * | 12/2005 | Poulsen ............... B82Y 5/00 435/5 |
| 2006/0019256 A1 | 1/2006 | Clarke et al. |
| 2006/0019615 A1 | 1/2006 | Ditmer |
| 2006/0035244 A1 | 2/2006 | Riggins et al. |
| 2006/0046253 A1 | 3/2006 | Nakao |
| 2006/0046265 A1 | 3/2006 | Becker et al. |
| 2006/0083744 A1 | 4/2006 | Chen et al. |
| 2006/0088851 A1 | 4/2006 | Erlander et al. |
| 2006/0094061 A1 | 5/2006 | Brys et al. |
| 2006/0105360 A1 | 5/2006 | Croce et al. |
| 2006/0127907 A1 | 6/2006 | Matsubara et al. |
| 2006/0134663 A1 | 6/2006 | Harkin et al. |
| 2006/0204989 A1 | 9/2006 | Kopreski |
| 2006/0211017 A1 | 9/2006 | Chinnaiyan et al. |
| 2007/0010469 A1 * | 1/2007 | Chan ............... C12Q 1/6886 514/44 A |
| 2007/0020657 A1 | 1/2007 | Grebe et al. |
| 2007/0031873 A1 | 2/2007 | Wang et al. |
| 2007/0037165 A1 | 2/2007 | Venter et al. |
| 2007/0037186 A1 | 2/2007 | Jiang et al. |
| 2007/0048738 A1 | 3/2007 | Donkena et al. |
| 2007/0065827 A1 | 3/2007 | Pauloski et al. |
| 2007/0065833 A1 | 3/2007 | Gupta |
| 2007/0083334 A1 | 4/2007 | Mintz et al. |
| 2007/0099197 A1 | 5/2007 | Afar et al. |
| 2007/0099209 A1 | 5/2007 | Clarke et al. |
| 2007/0105133 A1 | 5/2007 | Clarke et al. |
| 2007/0148667 A1 | 6/2007 | Williams et al. |
| 2007/0148687 A1 | 6/2007 | Bedingham et al. |
| 2007/0161004 A1 | 7/2007 | Brown et al. |
| 2007/0172841 A1 | 7/2007 | Wang |
| 2007/0172844 A1 | 7/2007 | Lancaster et al. |
| 2007/0212702 A1 | 9/2007 | Tomlins et al. |
| 2007/0220621 A1 | 9/2007 | Clarke et al. |
| 2007/0238119 A1 | 10/2007 | Yu et al. |
| 2007/0259352 A1 | 11/2007 | Bentwich et al. |
| 2007/0275915 A1 | 11/2007 | Hallenbeck et al. |
| 2008/0009001 A1 | 1/2008 | Bettuzzi et al. |
| 2008/0028302 A1 | 1/2008 | Meschkat |
| 2008/0044824 A1 | 2/2008 | Giordano et al. |
| 2008/0076674 A1 | 3/2008 | Litman et al. |
| 2008/0124344 A1 | 5/2008 | Combs et al. |

(56) References Cited

U.S. PATENT DOCUMENTS

| | | |
|---|---|---|
| 2008/0131892 A1 | 6/2008 | Becker et al. |
| 2008/0145841 A1 | 6/2008 | Libutti et al. |
| 2008/0254470 A1 | 10/2008 | Berlkin |
| 2008/0269157 A1 | 10/2008 | Srivastava et al. |
| 2008/0274457 A1 | 11/2008 | Eng et al. |
| 2008/0281568 A1 | 11/2008 | Kao et al. |
| 2009/0020433 A1 | 1/2009 | Cohen et al. |
| 2009/0036415 A1 | 2/2009 | Rubin et al. |
| 2009/0062144 A1 | 3/2009 | Guo |
| 2009/0075921 A1 | 3/2009 | Ikegawa |
| 2009/0149333 A1 | 6/2009 | Knudsen et al. |
| 2009/0191535 A1 | 7/2009 | Connelly et al. |
| 2009/0204333 A1 | 8/2009 | Friend et al. |
| 2009/0239221 A1 | 9/2009 | Chinnaiyan et al. |
| 2009/0280490 A1 | 11/2009 | Baker et al. |
| 2009/0298082 A1 | 12/2009 | Klee et al. |
| 2010/0055704 A1 | 3/2010 | Giordano et al. |
| 2010/0075384 A1 | 3/2010 | Kong et al. |
| 2010/0099093 A1 | 4/2010 | Weaver et al. |
| 2010/0130377 A1 | 5/2010 | Vasmatzis et al. |
| 2010/0131286 A1 | 5/2010 | Houlgatte et al. |
| 2010/0131432 A1 | 5/2010 | Kennedy et al. |
| 2010/0178653 A1 | 7/2010 | Aharonov et al. |
| 2010/0021538 A1 | 8/2010 | Iljin et al. |
| 2010/0257617 A1 | 10/2010 | Ami et al. |
| 2010/0279327 A1 | 11/2010 | Ossovskaya |
| 2010/0285979 A1 | 11/2010 | Zeiger et al. |
| 2011/0009286 A1 | 1/2011 | Andre et al. |
| 2011/0045462 A1 | 2/2011 | Fu et al. |
| 2011/0092375 A1 | 4/2011 | Zamore et al. |
| 2011/0136683 A1 | 6/2011 | Davicioni |
| 2011/0152110 A1 | 6/2011 | Vierlinger et al. |
| 2011/0178163 A1 | 7/2011 | Chowdhury |
| 2011/0212855 A1 | 9/2011 | Rafnar et al. |
| 2011/0229894 A1 | 9/2011 | Levy et al. |
| 2011/0230372 A1 | 9/2011 | Willman et al. |
| 2011/0236903 A1 | 9/2011 | McClelland |
| 2011/0287946 A1 | 11/2011 | Gudmundsson et al. |
| 2011/0294123 A1 | 12/2011 | Nakamura et al. |
| 2011/0312520 A1 | 12/2011 | Kennedy et al. |
| 2012/0015839 A1 | 1/2012 | Chinnaiyan |
| 2012/0015843 A1 | 1/2012 | Von et al. |
| 2012/0041274 A1 | 2/2012 | Stone et al. |
| 2012/0108453 A1 | 5/2012 | Smit et al. |
| 2012/0115743 A1 | 5/2012 | Davicioni et al. |
| 2012/0122698 A1 | 5/2012 | Stacey et al. |
| 2012/0122718 A1 | 5/2012 | Reisman |
| 2012/0157334 A1 | 6/2012 | Beaudenon-Huibregtse et al. |
| 2012/0172243 A1 | 7/2012 | Davicioni et al. |
| 2012/0214165 A1 | 8/2012 | Walfish et al. |
| 2012/0220474 A1 | 8/2012 | Kennedy et al. |
| 2012/0304318 A1 | 11/2012 | Ohnuma et al. |
| 2013/0004974 A1 | 1/2013 | Klee et al. |
| 2013/0023434 A1 | 1/2013 | Van Laar |
| 2013/0142728 A1 | 6/2013 | Beaudenon-Huibregtse et al. |
| 2013/0150257 A1 | 6/2013 | Abdueva et al. |
| 2013/0172203 A1 | 7/2013 | Yeatman et al. |
| 2013/0184999 A1 | 7/2013 | Ding |
| 2013/0196866 A1 | 8/2013 | Pestano et al. |
| 2013/0225662 A1 | 8/2013 | Kennedy et al. |
| 2013/0231258 A1 | 9/2013 | Wilde et al. |
| 2013/0273543 A1 | 10/2013 | Gudmundsson et al. |
| 2013/0302808 A1 | 11/2013 | Vasmatzis |
| 2013/0302810 A1 | 11/2013 | Latham et al. |
| 2013/0303826 A1 | 11/2013 | Jurisica et al. |
| 2014/0030714 A1 | 1/2014 | Paschke et al. |
| 2014/0066323 A1 | 3/2014 | Buerki et al. |
| 2014/0080731 A1 | 3/2014 | Davicioni et al. |
| 2014/0087961 A1 | 3/2014 | Sulem et al. |
| 2014/0099261 A1 | 4/2014 | Keutgen et al. |
| 2014/0121126 A1 | 5/2014 | Bivona et al. |
| 2014/0143188 A1 | 5/2014 | Mackey et al. |
| 2014/0228237 A1 | 8/2014 | Kennedy et al. |
| 2014/0243240 A1 | 8/2014 | Soldin et al. |
| 2014/0302042 A1 | 10/2014 | Chin et al. |
| 2014/0315199 A1 | 10/2014 | Rhodes et al. |
| 2014/0315739 A1 | 10/2014 | Aharonov et al. |
| 2014/0349856 A1 | 11/2014 | Schnabel et al. |
| 2014/0349864 A1 | 11/2014 | Kennedy et al. |
| 2014/0371096 A1 | 12/2014 | Umbright et al. |
| 2015/0011401 A1 | 1/2015 | Davicioni et al. |
| 2015/0038376 A1 | 2/2015 | Tian et al. |
| 2015/0099665 A1 | 4/2015 | Rosenfeld et al. |
| 2015/0141470 A1 | 5/2015 | Garraway et al. |
| 2015/0275306 A1 | 10/2015 | Bernards et al. |
| 2015/0292030 A1 | 10/2015 | McConkey |
| 2015/0299808 A1 | 10/2015 | Gonzalez et al. |
| 2015/0307947 A1 | 10/2015 | Basu et al. |
| 2015/0329915 A1 | 11/2015 | Davicioni et al. |
| 2015/0368724 A1 | 12/2015 | Aharonov et al. |
| 2016/0024586 A1 | 1/2016 | Delfour et al. |
| 2016/0032395 A1 | 2/2016 | Davicioni et al. |
| 2016/0032400 A1 | 2/2016 | Gomis et al. |
| 2016/0068915 A1 | 3/2016 | Kennedy et al. |
| 2016/0076108 A1 | 3/2016 | Davicioni et al. |
| 2016/0115546 A1 | 4/2016 | Rosenfeld et al. |
| 2016/0120832 A1 | 5/2016 | Rabinowitz et al. |
| 2016/0251729 A1 | 9/2016 | Chinnaiyan et al. |
| 2016/0312305 A1 | 10/2016 | Kennedy et al. |
| 2016/0312306 A1 | 10/2016 | Kennedy et al. |
| 2016/0312307 A1 | 10/2016 | Kennedy et al. |
| 2016/0312308 A1 | 10/2016 | Kennedy et al. |
| 2016/0348184 A1 | 12/2016 | Chinnaiyan |
| 2017/0016076 A1 | 1/2017 | Barnett-Itzhaki et al. |
| 2017/0145513 A1 | 5/2017 | Kennedy et al. |
| 2017/0166980 A1 | 6/2017 | Fahey, III et al. |
| 2017/0329894 A1 | 11/2017 | Kennedy et al. |
| 2018/0016642 A1 | 1/2018 | Kennedy et al. |
| 2018/0030540 A1 | 2/2018 | Davicioni et al. |
| 2018/0068058 A1 | 3/2018 | Abdueva et al. |
| 2018/0112275 A1 | 4/2018 | Davicioni et al. |
| 2018/0122508 A1 | 5/2018 | Wilde et al. |
| 2018/0127832 A1 | 5/2018 | Kennedy et al. |
| 2020/0165682 A1 | 5/2020 | Chinnaiyan et al. |

FOREIGN PATENT DOCUMENTS

| | | |
|---|---|---|
| EP | 2 366 800 A1 | 9/2011 |
| WO | WO 1990/015070 A1 | 12/1990 |
| WO | WO 1992/010092 A1 | 6/1992 |
| WO | WO 1993/009668 A1 | 5/1993 |
| WO | WO 1993/022684 A1 | 11/1993 |
| WO | WO 1998/045420 A2 | 10/1998 |
| WO | WO-20011/060860 | 8/2001 |
| WO | WO 2001/066753 A1 | 9/2001 |
| WO | WO 2002/000929 A1 | 1/2002 |
| WO | WO 2002/083921 A2 | 10/2002 |
| WO | WO 2003/012067 A2 | 2/2003 |
| WO | WO 2004/037972 A2 | 5/2004 |
| WO | WO-2005/0040396 | 5/2005 |
| WO | WO 2005/085471 A2 | 9/2005 |
| WO | WO 2005/100608 A2 | 10/2005 |
| WO | WO 2006/047484 A2 | 5/2006 |
| WO | WO 2006/091776 A2 | 8/2006 |
| WO | WO-2006/0110264 | 10/2006 |
| WO | WO 2006/110264 A2 | 10/2006 |
| WO | WO 2006/127537 A2 | 11/2006 |
| WO | WO 2006/135596 A2 | 12/2006 |
| WO | WO 2007/056049 A2 | 5/2007 |
| WO | WO 2007/070621 A2 | 6/2007 |
| WO | WO 07/081740 | 7/2007 |
| WO | WO 2007/081720 A2 | 7/2007 |
| WO | WO 2008/023087 A2 | 2/2008 |
| WO | WO 2008/046911 A2 | 4/2008 |
| WO | WO 08/086478 | 7/2008 |
| WO | WO 2008/086478 A2 | 7/2008 |
| WO | WO 2008/112283 A2 | 9/2008 |
| WO | WO 2009/009432 A2 | 1/2009 |
| WO | WO 2009/020521 A2 | 2/2009 |
| WO | WO 2009/020905 A2 | 2/2009 |
| WO | WO 09029266 | 3/2009 |
| WO | WO 2009/045115 A1 | 4/2009 |
| WO | WO 09/074968 | 6/2009 |
| WO | WO 2009/143603 A1 | 12/2009 |

(56) References Cited

FOREIGN PATENT DOCUMENTS

| | | |
|---|---|---|
| WO | WO 10/018601 | 2/2010 |
| WO | WO 2010/056374 A2 | 5/2010 |
| WO | WO 10/073248 | 7/2010 |
| WO | WO 2010/056374 A3 | 9/2010 |
| WO | WO 2010/099598 A1 | 9/2010 |
| WO | WO 10/123626 | 10/2010 |
| WO | WO 2010/124372 A1 | 11/2010 |
| WO | WO 2011/150453 A1 | 12/2011 |
| WO | WO 2012/031008 A2 | 3/2012 |
| WO | WO 2012/068383 A2 | 5/2012 |
| WO | WO 2012/135008 A1 | 10/2012 |
| WO | WO 13/006495 | 1/2013 |
| WO | WO 2013/088457 A1 | 6/2013 |
| WO | WO 2013/090620 A1 | 6/2013 |
| WO | WO 2013/116742 A1 | 8/2013 |
| WO | WO 2014/028884 A2 | 2/2014 |
| WO | WO 2014/043803 A1 | 3/2014 |
| WO | WO 14/085666 | 5/2014 |
| WO | WO 14/151764 | 9/2014 |
| WO | WO 15/073949 | 5/2015 |
| WO | WO 2015/071876 A2 | 5/2015 |
| WO | WO 16/141127 | 9/2016 |
| WO | WO 17/062505 | 4/2017 |
| WO | WO 2017/059549 A1 | 4/2017 |
| WO | WO 2018/165600 A1 | 9/2018 |
| WO | WO 19/023517 | 1/2019 |

OTHER PUBLICATIONS

Bibikova et al: "Expression signatures that correlated with Gleason score and relapse in prostate cancer," Genomics, Jun. 2007;89(6):666-72. Epub Apr. 24, 2007.

Bueno et al., "A diagnostic test for prostate cancer from gene expression profiling data," J Urol, Feb. 2004;I71(2 Pt 1):903-6.

Cheville et at., "Gene Panel Model Predictive of Outcome in Men at High-Risk of Systemic Progression and Death From Prostate Cancer After Radical Retropubic Prostatectomy,"; Journal of Clinical Oncology vol. 26 , No. 24, Aug. 20, 2008.

Clark-Langone et al. Riornarker discovery for colon cancer using a 761 gene RT-PCR assay 2007. BMC Genomics 8:279 pp. 1-18 2007.

Cooper et al., "Mechanisms of Disease: biormirkers and molecular targets from microarray gene expression studies in prostate cancer," Nat Clin Pract Urol. Dec. 2007:4(12):677-87.

Cordon-Cardo et al., "Improved prediction of prostate cancer recurrence through systems pathology," The Journal of Clinical Investigation, vol. 117 No. 7 Jul. 2007.

European Search Report dated Nov. 3, 2011, regarding EP 09753364 6 pages.

Feroze-Merzoug et al., "Molecular profiling in prostate cancer," Cancer Metastasis Rev. 2001;20(3-4):165-71.

Glinsky et al., "Gene expression profiling predicts clinical outcome of prostate cancer," The Journal of Clinical Investigation, vol. 113 No. 6 Mar. 2004 .11 pages.

Henshall et al., "Survival Analysis of Genome-Wide Gene Expression Profiles of Prostate Cancers Identifies New Prognostic Targets of Disease Relapse," Cancer Research 63, 4196-4203, Jul. 15, 2003.

International Search Report dated Oct. 14, 2009, regarding PCTICA2009/000694, 5 pages.

Iviendiratta, P. et al.: Gcnomic signatures associated with the development, progression, and outcome of prostate cancer. Cancer. 2007, vol. 11, No. 6, pp. 345-354, ISSN 1177-1062.

Mendiratta et al., "Genomic signatures associated with the development, progression, and outcome of prostate cancer," Mo] Diagn Ther. 2007;11(6):345-54.

Nakagawa et al., "A Tissue Biomarker Panel Predicting Systematic Progression after PSA Recurrence Post-definitive Prostate Cancer Therapy," PLoS One, May 2008, vol. 3, Issue 5, 14 pages.

Nelson, P.S.: Predicting prostate cancer behavior using transcript profiles. J Urol. Nov. 2004;172(5 Pt 2):S28-32; discussion S33. Review.

Reddy et al., "Clinical utility of microarray-derived genetic signatures in predicting outcomes in prostate cancer," Clin Genitourin Cancer. Dec. 2006;5(3):187-9.

Rhodes et al.: "Multiplex biomarker approach for determining risk of prostatespecific antigen-defined recurrence of prostate cancer," Journ. Nat'l. Cancer Inst., vol. 95, No. 9, May 7, 2003, pp. 661-668.

Schlomm et al., "Molecular staging of prostate cancer in the year 2007," World .J. Urol. Mar. 2007;25(1): I 9-30. Epub Mar. 2, 2007.

Sequence Alignment Search for SEQ ID No. 457. Jan. 28, 2014. 2 pages.

Sequence Alignment Search for SEQ ID No. 1904. Jan. 28, 2014. 1 page.

Shariat et al., "An updated catalog of prostate cancer predictive tools," Cancer 2008, 113(11):3062-6.

Stephenson et al., "Integration of gene expression profiling and clinical variables to m predict prostate carcinoma recurrence after radical prostatectoy," Cancer Jul. 15, 2005:104(2):290-8.

Talantov et al., "Gene Based Prediction of Clinically Localized Prostate Cancer Progression After Radical Prostatectomy," The Journal of Urology, vol. 184, 1521-1528, Oct. 2010.

True et al "A molecular correlate to the Gleason grading system for prostate adenocarcinoma," Proc Nati Acad Sci U S A. Jul. 18, 2006;103(29):10991-6. Epub Jul. 7, 2006.

Yu et al., "Gene expression alterations in prostate cancer predicting tumor aggression and preceding development of malignancy," J Clin Oncol. Jul. 15, 2004;22(14):2790-9.

Agell et al., "A 12-Gene Expression Signature is Associated with Aggressive Histological in Prostate Cancer: SEC14L1 and TCEB1 Genes are Potential Markers of Progression," Am J Pathol (2012) vol. 181 (5), pp. 1585-1594.

Aldred et al., "Papillary and follicular thyroid carcinomas show distinctly different microarray expression profiles and can be distinguished by a minimum of five genes," J Clin Oncol. (2004) 22(17):3531-9.

Amundson et al., "Integrating global gene expression and radiation survival parameters across the 60 cell lines of the National Cancer Institute Anticancer Drug Screen," Cancer Research (2008) 68(2):415-424.

Ausubel, et al. Current Protocols in Molecular Biology. Wiley & Sons, New York (1995) Table of Contents.

Baetke et al., "Molecular Pathways Involved in Prostate Carcinogenesis: Insights from Public Microarray Datasets," PLoS ONE (2012) 7(11):e49831, 1-11.

Ballman et al., "Faster cyclic loess: normalizing RNA arrays via linear models," Bioinformatics, 2004, 20 :2778-2786.

Bannert et al., "Retroelements and the human genome: new perspectives on an old relation." PNAS (Oct. 5, 2004) vol. 101, Suppl. 2, pp. 14572-14579.

Bauer et al., "Identification of Markers of Taxane Sensitivity Using Proteomic and Genomic Analyses of Breast Tumor from Patients Receiving Neoadjuvant Paclitaxel and Radiation," Clin. Cancer Res. (2010) 16(2):681-690, American Association for Cancer Research.

Bergstralh et al., "Software for optimal matching in observation al studies," Epidemiology (1996) 7(3):331-332.

Best et al., "Molecular differentiation of high- and moderate-grade human prostate cancer by cDNA microarray analysis", Diagn Mol Pathol. (2003) 12(2):63-70.

Bibikova et al., "Quantitative gene expression profiling in formalin-fixed, paraffin-embedded tissues using universal bead arrays," Am J Pathol. (2004) 165:1799-1807.

Bibikova et al., "Gene expression profiles in formalin-fixed, paraffin-embedded tissues obtained with a novel assay for microarray analysis," Clin Chem., 2004, 50:2384-2386.

Bibikova et al., "Expression signatures that correlated with Gleason score and relapse in prostate cancer," Genomics (2007) 89(6):666-672.

Birney et al., "Identification and analysis of functional elements in 1% of the human genome by the Encode pilot project." Nature Jun. 14, 2007; 447(7146):799-816.

Boorjian et al., "Long-term risk of clinical progression after biochemical recurrence following radical prostatectomy: the mpact of time from surgery to recurrence." Eur Urol. (Jun. 2011) 59(6):893-9.

(56) References Cited

OTHER PUBLICATIONS

Boormans et al., "Identification of TDRD1 as a direct target gene of ERG in primary prostate cancer," Int J Cancer (2013) vol. 133 (2), pp. 335-345.
Bostwick et al., "Prognostic factors in prostate cancer: College of American Pathologists consensus statement," Arch Pathol Lab Med (2000) 124(7):995-1000.
Bott et al., "Prostate cancer management: (2) an update on locally advanced and metastatic disease", Postgrad Med J, Dec. 3 2003, 79(937), 643-645.
Breiman, "Random Forests," Machine Learning (2001) 45:5-32.
Brouha et al., "Hot L1s account for the bulk of retrotransposition in the human population." PNAS USA (Apr. 29, 2003) 100(9):5280-5.
Bull et al., "Identification of potential diagnostic markers of prostate cancer and prostatic intraepithelial neoplasia using cDNA microarray," British J Cancer (Jun. 1, 2001) 84(11):1512-1519.
Bussmakers et al., "DD3: a new prostate-specific gene, highly overexpressed in prostate cancer." Cancer Res. (Dec. 1, 1999) 59(23):5975-9.
Cerutti et al. "Diagnosis of suspicious thyroid nodules using four protein biomarkers," Clin Cancer Res. (2006) 12(11 Pt 1):3311-8.
Chalitchagorn et al., "Distinctive pattern of LINE-1 methylation level in normal tissues and the association with carcinogenesis." Oncogene (Nov. 18, 2004) 23(54):8841-6.
Che et al.: "Prognostic Value of Abnormal p53 Expression in Locally Advanced Prostate Cancer Treated With Androgen Deprivation and Radiotherapy: A Study Based on RTOG 9202"; International Journal of Radiation: Oncology Biology Physics (Nov. 15, 2007) vol. 69, No. 4, pp. 1117-1123.
Chen et al., "Hepsin and maspin are inversely expressed in laser capture microdissectioned prostate cancer," J Urol. (Apr. 2003) 169(4):1316-1319.
Chen et al.: "Molecular determinants of resistance to antiandrogen therapy"; Nature Medicine, Nature Publishing Group, New York, NY (Jan. 1, 2004) vol. 10, No. 1, pp. 33-39.
Chen et al., "Significance of noninvasive diagnosis of prostate cancer with cytologic examination of prostatic fluid," J Nippon Med Sch. (Jun. 2006) 73(3):129-135.
Chen et al., "Deregulation of a Hox Protein Regulatory Network Spanning Prostate Cancer Initiation and Progression," Clin Cancer Res (Jun. 2012) 18(16):4291-4302.
Cheng et al. "Cell Proliferation in Prostate Cancer Patients with Lymph Node Metastasis", Clin Cancer Res (Oct. 1999) 5(10): 2820-2823.
Chifman et al., "Conservation of immune gene signatures in solid tumors and prognostic implications," BMC Cancer (2016) 16:911, pp. 1-17. DOI 10.1186/S12885-016-2948-Z.
Chow et al., "LINE-1 activity in facultative heterochromatin formation during X chromosome inactivation," Cell (Jun. 11, 2010) 141(6):956-69.
Cibas, et al. "The Bethesda System for Reporting Thyroid Cytopathology," Am J Clin Pathol. (Nov. 2009) 132(5):658-65. doi: 10.1309/AJCPPHLWMI3JV4LA.
Clancy et al., "Profiling networks of distinct immune-cells in tumors," BMC Bioinformatics (2016) 17:263, pp. 1-15. DOI 10.1186/s12859-016-1141-3.
Cooperberg et al., "The CAPRA-S score: A straightforward tool for improved prediction of outcomes after radical prostatectomy," Cancer (2011) vol. 117 (22), pp. 5039-5046.
Cordaux et al., "The impact of retrotransposons on human genome evolution." Nat Rev Genet. (Oct. 2009) 10(10):691-703.
Cuzik et al., "Prognostic value of an RNA expression signature derived from cell cycle proliferation genes in patients with prostate cancer: a restrospective study," thelancet.com/oncology (Mar. 2011) vol. 12, pp. 245-255.
Dahlman et al., "Effect of androgen deprivation therapy on the expression of prostate cancer biomarkets MSMB and MSMB-binding protein CRISP3," Prostate Cancer and Prostatic Diseases (2010) 13:369-375.

Dalela et al., "Contemporary Role of the Decipher Test in Prostate Cancer Management: Current Practice and Future Perspectives," Rev. Urol. (2016), 18(1):1-9, MedReviews®, LLC.
Dalsgaard Sorensen et al.: "Discovery of prostate cancer biomarkers by microarray gene expression profiling"; Expert Review of Molecular Diagnostics, vol. 10, No. 1, Jan. 1, 2010, pp. 49-64.
D'Amico et al., "Cancer-specific mortality after surgery or radiation for patients with clinically localized prostate cancer managed during the prostate-specific antigen era," J Clin Oncol. (2003) 21:2163-2172.
Dawood, Shaheenah, "Novel Biomarkers of Metastatic Cancer," Expert Rev. Mo/. Diagn. (2010) 10(5):581-590, Expert Reviews Ltd.
Day et al., "Estimating enrichment of repetitive elements from high-throughput sequence data." Genome Biol. (2010) 11 (6):R69.
Dechassa et al., "Architecture of the SWI/SNF-nucleosome complex," Mol Cell Biol. (Oct. 2008) vol. 28, No. 19, pp. 6010-6021.
Demichelis et al., "TMPRSS2:ERG gene fusion associated with lethal prostate cancer in a watchful waiting cohort," Oncogene (2007) 26:4596-4599.
Dhanasekaran et al., "Delineation of prognostic biomarkers in prostate cancer," Nature (2001) 412: 822-826.
Dougherty, "The fundamental role of pattern recognition for gene-expression/microarray data in bioinformatics," Pattern recognition (2005) 38:2226-2228.
Eder et al., "Genes differentially expressed in prostate cancer," BJU Int. (May 2004) 93(8): 1151-1155.
Edwards et al.: "MicroRNAs and Ultraconserved Genes as Diagnostic Markers and Therapeutic Targets in Cancer and Cardiovascular Diseases", Journal of Cardiovascular Translational Research (May 5, 2010) vol. 3, No. 3, pp. 271-279.
Englisch, et al., "Chemically Modified Oligonucleotides as Probes and Inhibitors," Angew. Chem. Int. Ed. Eng. (1991) 30:613-629.
Erho et al., "Discovery and Validation of a Prostate Cancer Genomic Classifier that Predicts Early Metastasis Following Radical Prostatectomy," PLoS ONE (2013) 8(6):e66855, 1-12.
Ernst et al., "Decrease and gain of gene expression are equally discriminatory markers for prostate carcinoma: a gene expression analysis on total and microdissected prostate tissue," Am J Pathol. (Jun. 2002) 160(6):2169-2180.
Etzioni et al. "The case for early detection", Nature Reviews 1 Cancer (Apr. 2003) vol. 3, pp. 1-10.
Fan et al., "Concordance among gene-expression-based predictors for breast cancer," N Engl J Med. (2006) 355:560-569.
Finley et al., "Discrimination of benign and malignant thyroid nodules by molecular profiling," Ann Surg. (2004) 240(3):425-36; discussion 436-7.
Finley et al., "Advancing the molecular diagnosis of thyroid nodules: defining benign lesions by molecular profiling," Thyroid (2005) 15(6):562-8.
Fodor et al., "Light-directed, spatially addressable parallel chemical synthesis," Science (Feb. 15, 1991) 251(4995):767-773.
Foley et al., "Molecular pathology of prostate cancer: the key to identifying new biomarkers of disease," Endocrine-Related Cancer (2004) 11:477-488.
Fontaine, et al., "Increasing the number of thyroid lesions classes in microarray analysis improves the relevance of diagnostic markers," PLoS One (Oct. 29, 2009) 4(10):e7632. doi: 10.1371/journal.pone.0007632.
Fryknas et al., "Molecular markers for discrimination of benign and malignant follicular thyroid tumors," Tumour Biol. (2006) 27(4):211-20.
Fujarewicz et al., "A multi-gene approach to differentiate papillary thyroid carcinoma from benign lesions: gene selection using support vector machines with bootstrapping," Endocr Relat Cancer (Sep. 2007) 14(3):809-26.
Gait. Chapter 16: Oligoribonucleotides. Antisense Research and Applications, Crookeand Lebleu Eds., CRC Press (1993) pp. 289-302.
Galamb et al., "Diagnostic mRNA Expression Patterns of Inflamed, Benign, and Malignant Colorectal Biopsy Specimen and their Correlation with Peripheral Blood Results," Cancer Epidemiology, Biomarkers & Prevention (Oct. 2008) 17(10):2835-2845.

(56) References Cited

OTHER PUBLICATIONS

Gao et al., "Vista is an inhibitory immune checkpoint that is increased after ipilimumab therapy in patients with prostate cancer," Nat Med. (May 2017) 23(5):551-555.
Genevieve de Saint Basile et al., "Severe Combined Immunodeficiency Caused by Deficiency in Either the Ii or the E Subunit of CD3," Journal of Clinical Investigation (2004) vol. 114, No. 10. p. 1512-1517.
Gibb et al., "The functional role of long non-coding RNA in human carcinomas", Molecular Cancer, Biomed Central, London, GB (Apr. 13, 2011) vol. 10, No. 1, p. 38.
Giordano et al., "Organ-Specific Molecular Classification of Primary Lung, Colon, and Ovarian Adenocarcinomas Using Gene Expression Profiles," Am J Pathol (2001) 159(4):1231-1238.
Glinsky et al., "Gene expression profiling predicts clinical outcome of prostate cancer," J Clin Investigation (2004) 113(6):913-923.
Glinsky et al., "Microarray analysis identifies a death-from-cancer signature predicting therapy i failure in patients with multiple types of cancer," J Clin Invest. (2005) 115: 1503-1521.
Greenbaum et al.: "Comparing protein abundance and mRNA expression levels on a genomic scale"; Genome Biology (2003) 4(9):117.1-117.8.
Griffith et al., "Meta-analysis and meta-review of thyroid cancer gene expression profiling studies identifies important diagnostic biomarkers," J Clin Oncol. (2006) 24(31):5043-51.
Griffith, et al. Biomarker panel diagnosis of thyroid cancer: a critical review. Expert Rev Anticancer Ther. (Sep. 2008) 8(9):1399-413. doi: 10.1586/14737140.8.9.1399.
Gupta et al., "Long non-coding RNA HOTAIR reprograms chromatin state to promote cancer metastasis," Nature (Apr. 15, 2010) 464(7291): 1071-6.
Guttman et al., "Chromatin signature reveals over a thousand highly conserved large non-coding RNAs in mammals", Nature (Mar. 12, 2009) 458(7235):223-7.
Guttman et al., "Ab initio reconstruction of transcriptomes of pluripotent and lineage committed cells reveals gene structures of thousands of lincRNAs," Nat Biotechnol. (May 2010) 28(5):503-10.
Haiman et al.: "Multiple regions within 8q24 independently affect risk for prostate cancer"; Nat Genet. (2007) 39:638-644.
Hamada et al., "Diagnostic usefulness of PCR profiling of the differentially expressed marker genes in thyroid papillary carcinomas," Cancer Lett. (Jun. 28, 2005) 224(2):289-301. Epub Nov. 18, 2004.
He et al., "The antisense transcriptomes of human cells", Science (Dec. 19, 2008) 322(5909): 1855-7.
Heemers, H. V. et al.: "Identification of a Clinically Relevant Androgen-Dependent Gene Signature in Prostate Cancer"; Cancer Research, vol. 71, No. 5 (2011) pp. 1978-1988.
Heidenreich et al., "EAU Guidelines on Prostate Cancer. Part 1: Screening, Diagnosis, and Treatment of Clinically Localised Disease," European Urology (2011) vol. 59, pp. 61-71.
Holzbeierlein et al., "Gene expression analysis of human prostate carcinoma during hormonal therapy identifies androgen-responsive genes and mechanisms of therapy resistance," Am. J . Pathol. (Jan. 2004) 164(1):217-227.
Hornberger et al., "A Multigene Prognostic Assay for Selection of Adjuvant Chemotherapy in Patients with T3, Stage II Colon Cancer: Impact on Quality-Adjusted Life Expectancy and Costs," Value in Health 15 (2012) pp. 1014-1021.
Huarte et al., "Large non-coding RNAs: missing links in cancer?" Human Molecular Genetics (Oct. 15, 2010) 19(2): R152- R161.
Hughes et al., "Molecular pathology of prostate cancer," J Clin Pathol. (Jul. 2005) 58(7):673-684.
Hughes et al., "Topoisomerase II—a expression increases with increasing Gleason score and with hormone insensitivity in prostate carcinoma," J Clin Pathol. (Jul. 2006) 59(7): 721-724.
Jenkins et al., "Prognostic significance of ailetic imbalance of chromosome arms 71, 8p, 16q, and 18q in stage T3NOMO prostate cancer," Genes, Chromosomes & Cancer (1998) 21:131-143.

Jhavar et al., "Integration of ERG gene mapping and geneDexpression profiling identifies distinct categories of human prostate cancer," BJUI (2008) vol. 103 (9), pp. 1256-1269.
Kanehisa, "Use of statistical criteria for screening potential homologies in nucleic acid sequences," Nucleic Acids Res. (Jan. 11, 1984) 12(1 Pt 1):203-13.
Karayi et al., "Molecular biology of prostate cancer," Prostate Cancer Prostatic Dis. (2004) 7(1):6-20.
Karnes et al., "The ability of biomarkers to predict systemic progression in men with high-risk prostate cancer treated surgically is dependent on ERG status," Cancer Res. (Nov. 9, 2010) 70(22):8994-9002, Epub.
Kasraeian, et al. , "A comparison of fine-needle aspiration, core biopsy, and surgical biopsy in the diagnosis of extremity soft tissue masses," Clin Orthop Relat Res. (Nov. 2010) 468(11):2992-3002.
Kawamorita et al., "Radical prostatectomy for high-risk prostate cancer: Biochemical outcome," International Journal of Urology (2009) 16:733-738.
Kebebew et al., "Diagnostic and extent of disease multigene assay for malignant thyroid neoplasms," Cancer (2006) 106(12):2592-7.
Khor et al.: "Bcl-2 and Bax Expression Predict Prostate Cancer Outcome in Men Treated with Androgen Deprivation and Radiotherapy on Radiation Therapy Oncology Group Protocol 92-02"; Clinical Cancer Research (Jun. 15, 2007) vol. 13, No. 12, pp. 3585-3590.
Kiessling, et al., "D-TMPP: A novel androgen-regulated gene preferentially expressed in prostate and prostate cancer that is the first characterized member of an eukaryotic gene family," The Prostate (2005) 64:387-400.
Kikuchi et al., "Expression profiles of non-small cell lung cancers on cDNA microarrays: identification of genes for prediction of lymph-node metastasis and sensitivity to anti-cancer drugs," Oncogene (2003) 22, pp. 2192-2205.
Kishi et al., "Expression of the survivin gene in prostate cancer: correlation with clinicopathological characteristics, proliferative activity and apoptosis," J Urol. (May 2004) 171(5): 1855-1860.
Klee et al., "Candidate Serum Biomarkers for Prostate Adenocarcinoma identified by mRNA Differences in Prostate Tissue and Verified with Protein Measurements in Tissue and Blood," Clinical Chemistry (2012) 58(3):599-609.
Kosari et al., "Identification of biomarkers for prostate cancer," Clin. Cancer Res. (2008) 1734-1743.
Koshkin et al., "LNA (locked nucleic acids): An RNA mimic forming exceedingly stable LNA," LNA duplexes. J Am Chem Soc (1998) 120:13252-13253.
Koshkin et al., "LNA (locked nucleic acids): synthesis of the adenine, cytosine, guanine 5-methylcytosine, thymine and uracil bicyclonucleoside monomers, oligomerisation, and unprecedented nucleic acid recognition," Tetrahedron (1998) 54(14):3607-3630.
Kroschwitz The Concise Encyclopedia of Polymer Science and Engineering (1990) (pp. 858-859).
Kube et al., "Optimization of laser capture microdissection and RNA amplification for gene expression profiling of prostate cancer," BMC Mol. Biol. (2007) 8:25.
Kumar, et al., "The first analogues of LNA (locked nucleic acids): phosphorothioate-LNA and 2'-thio-LNA," Bioorg Med Chem Lett. (Aug. 18, 1998) 8(16):2219-22.
Lapointe et al., "Gene expression profiling identifies clinically relevant subtypes of prostate cancer," PNAS USA (2004) 101:811-816.
Latulippe et al., "Comprehensive Gene Expression Analysis of Prostate Cancer Reveals Distinct Transcriptional Programs Associated with Metastatic Disease," Cancer Res. (2002) 62:4499-4506.
Liong et al., "Blood-Based Biomarkers of Aggressive Prostate Cancer," PLoS ONE (Sep. 2012) vol. 7, Issue 7, e45802, pp. 1-7.
Lockstone, "Exon array data analysis using Affymetrix power tools and R statistical software," Briefings in bioinformatics (2011) vol. 12 (6), pp. 634-644.
Lunardi et al., "A co-clinical approach identified mechanisms and potential therapies for androgen deprivation resistance in prostate cancer," Nature Genetics (Jul. 2013) vol. 45, No. 7, pp. 747-757.

(56) References Cited

OTHER PUBLICATIONS

Luo et al., "Human Prostate Cancer and Benign Prostatic Hyperplasia : Molecular Dissection by Gene Expression Profiling," Cancer Res. (2001) 61:4683-4688.
Magee et al., "Expression Profiling Reveals Hepsin Overexpression in Prostate Cancer," Cancer Res. (2001) 61:5692-5696.
Martens-Uzunova, E. S. et al.: "Diagnostic and prognostic signatures from the small non-coding RNA transcriptome in prostate cancer", Oncogene (Jul. 18, 2011) vol. 31, No. 8, pp. 978-991.
Martin, "A New Access to 2'-O-Alkylated Ribonucleosides and Properties of 2'-O-Alkylated Oligoribonucleotides," Helv. Chim. Acta. (1995) 78:486-504. (in German with English abstract).
Mazzanti, et al., "Using gene expression profiling to differentiate benign versus malignant thyroid tumors," Cancer Res. (Apr. 15, 2004) 64(8):2898-903.
McCall et al., "Frozen robust multiarray analysis (fRMA)", Biostatistics (2010) vol. 11 (2), 242-253.
Mercer, DW "Use of multiple markers to enhance clinical utility", Immunol Ser. (1990) 53: 39-54.
Mineva et al., "Differential expression of alphaB-crystallin and Hsp27-1 in anaplastic thyroid carcinomas because of tumor-specific alphaB-crystallin gene (CRYAB) silencing," Cell Stress Chaperones (Autumn 2005) 10(3):171-84.
Mühlenbruch et al., "Multiple imputation was a valid approach to estimate absolute risk from a prediction model based on case—cohort data," Journal of Clinical Epidemiology (2017) 84:130-141.
Nakagawa et al., "A Tissue Biomarker Panel Predicting Systemic Progression after PSA Recurrence Post-Definitive Prostate Cancer Therapy," PLos ONE (2008) 3(5):e2318, 14 pages.
Newson, Roger, "Confidence intervals for rank statistics: Somers' D and extensions," The Stata Journal (Sep. 2006) 6(3):309-334.
Nielsen et al., "Sequence-selective recognition of DNA by strand displacement with a thymine-substituted polyamide," Science (1991) 254: 1497-1500.
Noordzij et al. "The prognostic value of CD44 isoforms in prostate cancer patients treated by radical prostatectomy", Clin Cancer Res (May 1997) 3(5): 805-815.
Norman, James, "Thyroid Nodule Ultrasound", Endocrine website (Updated Oct. 13, 2010) http://www.endocrineweb.com/noduleus.html.
Ong et al., "Expression Profiling Identifies a Novel—Methylacyl-CoA Racemase Exon with Fumarate Hydratase Homology," Cancer Research (Jun. 15, 2003) 63:3296-3301.
Parker et al., "High expression levels of surviving protein independently predict a poor outcome for patients who undergo surgery for clear cell renal cell carcinoma," Cancer (2006) 107:37-45.
Pascal et al., "Correlation of mRNA and protein levels: Cell type-specific gene expression of cluster designation antigens in the prostate," BMC Genomics (2008) 9:246 (13 pages).
Patel et al., "Preoperative PSA velocity is an independent prognostic factor for relapse after radical prostatectomy," J Clin Oncol. (2005) 23:6157-6162.
Penney et al., "mRNA Expression Signature of Gleason Grade Predicts Lethal Prostate Cancer," J Clin Oncol (Jun. 10, 2011) vol. 29, No. 17, pp. 2391-2396.
Penney et al., "Appendix (online only) of Penney et al., J Clin Oncol 29:2391 (Jun. 2011; online May 2, 2011)" pp. 1-9.
Pereira et al, "Coagulation factor V and VIIIN ratio as predictors of outcome in paracetamol induced fulminant hepatic failure: relation to other prognostic indicators," Gut (1992) 33:98-102.
Perez et al., "Long, abundantly expressed non-coding transcripts are altered in cancer," Human Molecular Genetics (2008) vol. 17, No. 5, pp. 642-655.
Pienta et al. "The current state of preclinical prostate cancer animal models"; Prostate (2008) 69: 629-639.
Pilepich et al., "Phase III radiation therapy oncology group (RTOG) trial 86-10 of androgen deprivation adjuvant to definitive radiotherapy in locally advanced carcinoma of the prostate," Int. J. Radiation Oncology Biol. Phys. (2001) vol. 50, No. 5, pp. 1243-1252.
Pinover et al., "Validation of a treatment policy for patients with prostate specific antigen failure after three-dimensional conformal prostate radiation therapy," Cancer (Feb. 15, 2003) vol. 97, No. 4, pp. 1127-1133.
Pittoni et al., "The Dark Side of Mast Cell-Targeted Therapy in Prostate Cancer," Cancer Res. (2012) 72(4):831-835.
Porkka et al., "Molecular mechanisms of prostate cancer," Eur Urol. (2004) 45(6):683-691.
Pound et al., "Natural history of progression after Psa elevation following radical prostatectomy," JAMA (1999) 281:1591-1597.
Prasad et al., "Identification of genes differentially expressed in benign versus malignant thyroid tumors," Clin Cancer Res. (2008) 14(11):3327-37.
Prensner et al., "Transcriptome Sequencing Identifies PCAT-1, a Novel lincRNA Implicated in Prostate Cancer Progression," (2012) 29 (8): 742-749.
Puskas, et al., "Gene profiling identifies genes specific for well-differentiated epithelial thyroid tumors," Cell Mol Biol (Noisy-le-grand) (Sep. 5, 2005) 51(2):177-86.
Reis et al., "Antisense intronic non-coding RNA levels correlate to the degree of tumor differentiation in prostate cancer," Oncogene (2004) 23(39):6684-6692.
Rhodes et al., "ONCOMINE: A Cancer Microarray Database and Integrated Data-Mining Platform," Neoplasia (2004) 6:1-6.
Rhodes et al., "Large-scale meta-analysis of cancer microarray data identifies common transcriptional profiles of neoplastic transformation and progression," Proc Nat Acad Sci USA (2004) 101:9309-9314.
Rinn et al., "Functional demarcation of active and silent chromatin domains in human HOX loci by noncoding RNAs," Cell (Jun. 29, 2007) 129(7):1311-23.
Robertson et al., "DNA in radical prostatectomy specimens. Prognostic value of tumor ploidy," Acta Oncologica (1991) 30(2):205-207.
Robinson, et al., "A comparison of Affymetrix gene expression arrays," BMC Bioinformatics (Nov. 15, 2007) 8:449.
Robinson et al., "A dynamic programming approach for the alignment of signal peaks in multiple gas chromatography-mass spectrometry experiments," BMC Bioinformatics (2007) 8.1:419.
Rotblat et al., "A Possible Role for Long Non-Coding RNA in Modulating Signaling Pathways," Med. Hvnotheses (2011) 77:962-965, Elsevier.
Rotunno et al., "A Gene Expression Signature from Peripheral Whole Blood for Stage I Lung Adenocarcinoma," Cancer Prevention Research (Jul. 8, 2011) 4(10) 1599-1607.
Rubin et al., "Molecular genetics of human prostate cancer," Modern Pathol. (2004) 17(3):380-388.
Sanghvi, "Heterocyclic base modifications in nucleic acids and their applications in antisense oligonucleotides in Antisense Research and Applications," Crooke, S. T. and Lebleu, B., ed., CRC Press. (1993) Ch 15 274-285.
Saramaki et al., "Amplification of EIF3S3 gene is associated with advanced stage in prostate cancer," Am J Pathol. (2001) 159:2089-2094.
Sato et al., "Clinical significance of alterations of chromosome 8 in high-grade, advanced, nonmetastatic prostate carcinoma," J Natl Cancer Inst. (1999) 91:1574-1580.
Schumacher et al., "A Common 8q24 Variant in Prostate and Breast Cancer from a Large Nested Case-Control Study," Cancer Res. (2007) 67:2951-2956.
Severi et al., "The Common Variant rs1447295 on Chromosome 8q24 and Prostate Cancer Risk: Results from an Australian Population-based Case-Control Study", Cancer Epidemiology, Biomarkers & Prevention (2007) 16:610-611.
Shariat et al., "Survivin expression is associated with features of biologically aggressive prostate carcinoma," Cancer (2004) 100(4): 751-757.
Shibru et al., "Does the 3-gene diagnostic assay accurately distinguish benign from malignant thyroid neoplasms?" Cancer (Sep. 1, 2008) 113(5):930-5. doi: 10.1002/cncr.23703.
Shipley et al., "Radiation therapy for clinically localized prostate cancer: a multi-institutional pooled analysis," JAMA (1999) 281:1598-1604.

(56) References Cited

OTHER PUBLICATIONS

Simmons et al., "Natural history of biochemical recurrence after radical prostatectomy: risk assessment for secondary herapy," Eur Urol. (May 2007) 51(5):1175-84.
Singh et al., "LNA (locked nucleic acids): synthesis and high-affinity nucleic acid recognition," Chem Commun (1998) 4:455-456.
Singh et al., "Synthesis of 2'-amino-LNA: A novel conformationally restricted high-affinity oligonucleotide analogues with a handle," J Bio Chem (1998) 63:10035-10039.
Singh et al., "Gene expression correlates of clinical prostate cancer behavior," Cancer Cell (Mar. 2002) vol. 1, pp. 1203-1209.
Srikantan et al., "PCGEM1, a prostate-specific gene, is overexpressed in prostate cancer," PNAS (Oct. 24, 2000) 97(22): 12216-12221.
Stanbrough et al., "Increased Expression of Genes Converting Adrenal Androgens to Testosterone in Androgen-Independent Prostate Cancer," Cancer Res (Mar. 1, 2006) 66(5):2815-2825.
Stephenson et al., "Integration of gene expression profiling and clinical variables to predict prostate carcinoma recurrence after radical prostatectomy," Cancer (Jul. 15, 2005) 104(2):290-298.
Subramanian et al., "Gene set enrichment analysis: A knowledge-based approach for interpreting genome-wide expression profiles," PNAS USA (2005) 102:15545-15550.
Taft et al., "Non-coding RNAs: regulators of disease," J Pathol. (Jan. 2010) 220(2):126-39.
Takayama et al., "TACC2 is an Androgen-Responsive Cell Cycle Regulator Promoting Androgen-Mediatged and Castration-Resistant Growth of Prostate Cancer," Mol Endocrinol (May 2012) 26(5):748-761.
Taylor et al., "Integrative genomic profiling of human prostate cancer," Cancer Cell (Jul. 13, 2010) vol. 18 (1), pp. 11-22.
Thompson et al., "Adjuvant and Salvage Radiotherapy After Prostatectomy: AUA/ASTRO Guideline," J Urol. (2013) 190(2):441-449.
Thorsen et al., "Alternative Splicing in Colon, Bladder, and Prostate Cancer Identified by Exon Array Analysis," Molecular & Cellular Proteomics (Mar. 18, 2008) vol. 7, No. 7, pp. 1214-1224.
Tockman et al., "Considerations in bringing a cancer biomarker to clinical application," Cancer Research (1992) 52:2711-2718.
Tomlins et al., "Recurrent Fusion of TMPRSS2 and ETS Transcription Factor Genes in Prostate Cancer," Science (2005) 310(5748):644-648.
Tomlins et al., "TMPRSS2:ETV4 Gene Fusions Define a Third Molecular Subtype of Prostate Cancer," Cancer Res. (2006) 66:3396-3400.
Tomlins et al., "Distinct classes of chromosomal rearrangements create oncogenic ETS gene fusions in prostate cancer," Nature (Aug. 2, 2007) 448(7153):595-9.
Tricoli et al., "Detection of prostate cancer and predicting progression: current and future diagnostic markers," Clinical Cancer Research (Jun. 15, 2004) 10:3943-3953.
Tsuchiya et al., "Mapping and gene expression profile of the minimally overrepresented 8q24 region in prostate cancer," Am J Pathol. (May 2002) 160(5):1799-1806.
Vanaja et al., "Transcriptional Silencing of Zinc Finger Protein 185 Identified Profiling is Associated with Prostate Cancer Progression," Cancer Research (Jul. 15, 2003) 63:3877-3882.
Vanaja et al., "PDLIM4 Repression by Hypermethylation as a Potential Biomarker for Prostate Cancer," Clin. Cancer Res. (2006) 12(4):1128-1136.
Varambally et al., "Integrative Genomic and Proteomic Analysis of Prostate Cancer Reveals Signatures of Metastatic Progression," Cancer Cell (Nov. 2005) 8(5):393-406.
Varela et al., "Exome sequencing identifies frequent mutation of the SWI/SNF complex gene PBRM1 in renal carcinoma," Nature (Jan. 27, 2011) 469(7331):539-42.
Varricchi et al., "Are Mast Cells MASTers in Cancer?" Front Immunol. ePub (Apr. 12, 2017) 8:424.
Vickers et al., "Extensions to decision curve analysis, a novel method for evaluating diagnostic tests, prediction models and molecular markers, BMC Medical Informatics and Decision Making," (2008) 8(53):1-17.
Wang et al., "Two common chromosome 8q24 variants are associated with increased risk for prostate cancer," Cancer Res. (2007) 67:2944-2950.
Wang et al., "RNA-Seq: a revolutionary tool for transcriptomics," Nature Reviews/Genetics (Jan. 2009) vol. 10, pp. 57-63.
Watson et al., "Future opportunities for the diagnosis and treatment of prostate cancer," Prostate Cancer Prostatic Dis. (2004) 7:S8-S13.
Weber et al., "The prognostic value of expression of HIF1 [alpha], EGFR and VEGF-A, in localized prostate cancer for intermediate- and high-risk patients treated with radiation therapy with or without androgen deprivation therapy," Radiation Oncology (Apr. 30, 2012) vol. 7, No. 66, 8 pages.
Welsh et al., "Analysis of Gene Expression Identifies Candidate Markers and Pharmacological Targets in Prostate Cancer," Cancer Res. (Aug. 15, 2001) 61:5974-5978.
Wiegand et al., "ARID1A mutations in endometriosis-associated ovarian carcinomas," N Engl J Med. (Oct. 14, 2010) 363 (16):1532-43.
Yap et al., "Molecular interplay of the noncoding RNA ANRIL and methylated histone H3 lysine 27 by polycomb CBX7 n transcriptional silencing of INK4a," Mol Cell. (Jun. 11, 2010) 38(5):662-74.
Yates et al., "X:Map: annotation and visualization of genome structure for Affymetrix exon array analysis," Nucleic Acids Res. (2008) vol. 36:D780-D786.
Yegnasubramanian et al., "DNA hypomethylation arises later in prostate cancer progression than CpG island hypermethylation and contributes to metastatic tumor heterogeneity," Cancer Res. (Nov. 1, 2008) 68(21): pp. 8954-8967.
Yu et al., "Gene expression alterations in prostate cancer predicting tumor aggression and preceding development of malignancy," J Clin Oncol. (Jul. 15, 2004) 22(14):2790-2799.
Yu et al., "An integrated network of androgen receptor, polycomb, and TMPRSS2-ERG gene fusions in prostate cancer progression," Cancer Cell. (May 18, 2010) 17(5):443-54.
Yukinawa et al., "A multi-class predictor based on a probabilistic model: application to gene expression profiling-based diagnosis of thyroid tumors," BMC Genomics (Jul. 27, 2006) 7:190.
Zhao et al., "Development and validation of a 24-gene predictor of response to postoperative radiotherapy in prostate cancer: a matched, retrospective analysis," Lancet Oncol (2016) 17, pp. 1612-1620.
GenBank Accession No. AA462934 dated Jun. 10, 1997, 2 pages.
GenBank Accession No. AA920095 dated Apr. 20, 1998, 2 pages.
GenBank Accession No. AB028840 dated Jan. 12, 2000, 2 pages.
GenBank Accession No. AB030836 dated Oct. 23, 1999, 2 pages.
GenBank Accession No. AB036741 dated Dec. 22, 2000, 3 pages.
GenBank Accession No. AF077349 dated Dec. 14, 2000, 2 pages.
GenBank Accession No. AF077351 dated Dec. 20, 2000, 3 pages.
GenBank Accession No. AF115517 dated Nov. 23, 2005, 4 pages.
GenBank Accession No. AI413910 dated Feb. 9, 1999, 2 pages.
GenBank Accession No. AI414999 dated Feb. 9, 1999, 2 pages.
GenBank Accession No. AI425960 dated Mar. 9, 1999, 2 pages.
GenBank Accession No. AI851940 dated Jul. 15, 1999, 2 pages.
GenBank Accession No. AK018022 dated Sep. 19, 2008, 4 pages.
GenBank Accession No. AK019341 dated Sep. 19, 2008, 3 pages.
GenBank Accession No. AK019342 dated Sep. 19, 2008, 3 pages.
GenBank Accession No. AK034387 dated Sep. 19, 2008, 4 pages.
GenBank Accession No. AK038229 dated Sep. 19, 2008, 4 pages.
GenBank Accession No. AK038434 dated Sep. 19, 2008, 4 pages.
GenBank Accession No. AK041534 dated Sep. 19, 2008, 4 pages.
GenBank Accession No. AK042683 dated Sep. 19, 2008, 4 pages.
GenBank Accession No. AK136096 dated Sep. 19, 2008, 4 pages.
GenBank Accession No. AK136101 dated Sep. 19, 2008, 4 pages.
GenBank Accession No. AK142768 dated Sep. 19, 2008, 3 pages.
GenBank Accession No. AL591433 dated Jan. 15, 2009, 56 pages.
GenBank Accession No. BC004702 dated Jul. 15, 2006, 3 pages.
GenBank Accession No. BC055737 dated Jul. 15, 2006, 2 pages.
GenBank Accession No. BC086799 dated Sep. 21, 2006, 3 pages.
GenBank Accession No. BF449664 dated Dec. 1, 2000, 1 page.
GenBank Accession No. BG063957 dated Jan. 26, 2001, 2 pages.

(56) References Cited

OTHER PUBLICATIONS

GenBank Accession No. BG077309 dated Dec. 17, 2003, 2 pages.
GenBank Accession No. BM114282 dated Jan. 30, 2002, 2 pages.
GenBank Accession No. BY023910 dated Dec. 6, 2002, 2 pages.
GenBank Accession No. CN724527 dated May 18, 2004, 2 pages.
GenBank Accession No. NM_000130 dated Oct. 18, 2009, 6 pages.
GenBank Accession No. NM_000493 dated Mar. 15, 2009, 4 pages.
GenBank Accession No. NM_000598, GI No. 62243067, dated Jun. 6, 2010, 5 pages.
GenBank Accession No. NM_000688, GI No. 40316942, dated Apr. 11, 2010, 5 pages.
GenBank Accession No. NM_001013398; GI No. 62243247, dated Jun. 6, 2010, 5 pages.
GenBank Accession No. NM_001034 dated Oct. 5, 2009, 5 pages.
GenBank Accession No. NM_001039573, GI No. 221316683, dated Mar. 4, 2010, 5 pages.
GenBank Accession No. NM_001049 dated Jun. 21, 2009, 4 pages.
GenBank Accession No. NM_001067 dated Oct. 18, 2009, 5 pages.
GenBank Accession No. NM_001098533, GI No. 237858579, dated May 7, 2010, 5 pages.
GenBank Accession No. NM_001130851; GI No. 195927024, dated Mar. 5, 2010, 4 pages.
GenBank Accession No. NM_001136154 dated Jan. 8, 2012, 6 pages.
GenBank Accession No. NM_001136155 dated Jan. 8, 2012, 6 pages.
GenBank Accession No. NM_001143998, GI No. 221316675, dated Mar. 4, 2010, 5 pages.
GenBank Accession No. NM_001143999, GI No. 221316679, dated Mar. 5, 2010, 5 pages.
GenBank Accession No. NM_001144001, GI No. 221316686, dated Mar. 4, 2010, 5 pages.
GenBank Accession No. NM_001160367, GI No. 237858581, dated May 7, 2010, 5 pages.
GenBank Accession No. NM_001786 dated Nov. 1, 2009, 4 pages.
GenBank Accession No. NM_001844 dated Sep. 28, 2009, 7 pages.
GenBank Accession No. NM_003003, GI No. 221316681, dated Mar. 4, 2010, 5 pages.
GenBank Accession No. NM_003014; GI No. 170784837, dated Mar. 13, 2010, 5 pages.
GenBank Accession No. NM_003184; GI No. 115527086, dated Mar. 4, 2010, 7 pages.
GenBank Accession No. NM_003873.3 dated Oct. 18, 2009, 4 pages.
GenBank Accession No. NM_004336; GI No. 211938448, dated Mar. 14, 2010, 6 pages.
GenBank Accession No. NM_004449 dated Jan. 8, 2012, 6 pages.
GenBank Accession No. NM_005025.2 dated Jul. 12, 2009, 4 pages.
GenBank Accession No. NM_005192, GI No. 195927023, dated Mar. 4, 2010, 4 pages.
GenBank Accession No. NM_005651.1 datedOct. 27, 2009, 3 pages.
GenBank Accession No. NM_006265, GI No. 208879448, dated Apr. 11, 2010, 6 pages.
GenBank Accession No. NM_006558 dated 812109, 3 pages.
GenBank Accession No. NM_006727 dated Oct. 18, 2009, 3 pages.
GenBank Accession No. NM_006819; GI No. 110225356, dated May 17, 2010, 5 pages.
GenBank Accession No. NM_012152; GI No. 183396778, dated Apr. 5, 2010, 5 pages.
GenBank Accession No. NM_014846; GI No. 120952850, dated Mar. 4, 2010, 6 pages.
GenBank Accession No. NM_016623; GI No. 42734437, dated Mar. 29, 2009, 4 pages.
GenBank Accession No. NM_018930 dated Feb. 10, 2008, 4 pages.
GenBank Accession No. NM_031966 GI No. 34304372, dated Jun. 6, 2010, 5 pages.
GenBank Accession No. NM_032334; GI No. 223468686, dated Mar. 5, 2010, 3 pages.
GenBank Accession No. NM_052987, GI No. 237858574, dated May 17, 2010, 5 pages.
GenBank Accession No. NM_052988, GI No. 237858573, dated May 17, 2010, 5 pages.
GenBank Accession No. NM_080546; GI No. 112363101, dated May 17, 2010, 6 pages.
GenBank Accession No. NM_080607 dated Sep. 3, 2009, 2 pages.
GenBank Accession No. NM_133445 dated Sep. 20, 2009, 5 pages.
GenBank Accession No. NM_138455; GI No. 34147546, dated May 7, 2010, 3 pages.
GenBank Accession No. NM_182918 dated Jan. 8, 2012, 6 pages.
GenBank Accession No. NM_199166, GI No. 40316938, dated Apr. 11, 2010, 5 pages.
GenBank Accession No. NP_001058 dated Dec. 25, 2011, 9 pages.
GenBank Accession No. W34764 dated May 13, 1996, 2 pages.
Supplemental Table 1 of U.S. Appl. No. 61/057,698, filed May 30, 2008, 13 pages.
Supplemental Table 2 of U.S. Appl. No. 61/057,698, filed May 30, 2008, 15 pages.
Supplemental Table 3 of U.S. Appl. No. 61/057,698, filed May 30, 2008, 21 pages.
Supplemental Table 4 of U.S. Appl. No. 61/057,698, filed May 30, 12008, 1 page.
Supplemental Table 5 of U.S. Appl. No. 61/057,698, filed May 30, 12008, 2 pages.
Supplemental Table 6 of U.S. Appl. No. 61/057,698, filed May 30, 2008, 1 page.
Adamo and Ladomery, "The Oncogene ERG: A Key Factor in Prostate Cancer," *Oncogene* (2016), 35:403-414.
Affymetrix GeneChip Human Genome U133 Array Set HG-U133A, Geo, Mar. 11, 2002, retrieved on Mar. 11, 2002.
Alberts et al., "Vesicular traffic in the secretory and endocytic pathways," Molecular Biology of the Cell (1994) 3rd Ed., p. 465.
Amling et al.: "Long-term hazard of progression after radical prostatectomy for clinically EB localized prostate cancer continued risk of biochemical failure after 5 years," J Urol. (2000) 164:101-105.
Amundadottir et al., "A common variant associated with prostate cancer in European and African populations," Nat Genet. (2006) 38:652-658.
Baggerly et al., "Deriving Chemosensitivity from Cell Lines: Forensic Bioinformatics and Reproducible Research in High-Throughput Biology," The Annals of Applied Sciences (2009) vol. 3, No. 4, pp. 1309-1334.
Benner et al., "Evolution, language and analogy in functional genomics," TRENDS in Genetics, (Jul. 2001) vol. 17, pp. 414-418.
Bismar et al., "ERG Protein Expression Reflects Hormonal Treatment Response and is Associated with Gleason Score and Prostate Cancer Specific Mortality," *Eur. J. Cancer* (2012), 48:538-546,Elsevier Ltd.
Biton et al., Nov. 20, 2014, Independent component analysis uncovers the landscape of the bladder tumor transcriptome and reveals insights into luminal and basal subtypes, Cell Reports, 9(4):1235-1245.
Blute et al., "Use of Gleason score, prostate specific antigen, seminal vesicle and margin status to predict biochemical failure after radical prostatectomy," J Urol (2001) 165: 119-125.
Boormans et al., "Identification of TDRD1 as a Direct Target Gene of Erg in Primary Prostate Cancer," *Int. J. Cancer* (2013), 133(2):335-346, UICC.
Erase et al., "TMPRSS2-ERG—specific transcriptional modulation is associated with prostate cancer biomarkers and TGF-β signaling," BMC Cancer (2011) 11(507):1-8.
Carninci et al., "The transcriptional landscape of the mammalian genome," Science (Sep. 2, 2005) 09(5740):1559-63.
Cheung et al., "Natural variation in human gene expression assessed in lymphoblastoid cells," Nature Genetics (2003) vol. 33, pp. 422-425.
Cho et al., "Hypermethylation of CpG island loci and hypomethylation of LINE-1 and Alu repeats in prostate denocarcinoma and their relationship to clinicopathological features", J Pathol (Feb. 2007) 211(3):269-77.

(56) References Cited

OTHER PUBLICATIONS

Choi et al., Feb. 2014, Identification of distinct basal and luminal subtypes of muscle-invasive bladder cancer with different sensitivities to frontline chemotherapy, Cancer Cell, 25(2):152-165.
Cologne et al., "Optimal Case-Control Matching in Practice," Epidemiology Resources Inc. (1995) 6(3):271-275.
Cordon-Cardo et al., "Improved prediction of prostate cancer recurrence through systems pathology," The Journal of Clinical Investigation (Jul. 2007) vol. 117, No. 7, pp. 1876-1883.
Couzin-Frankel, Jennifer, "As Questions Grow, Duke Halts Trials, Launches Investigation," Science (Aug. 6, 2010) vol. 329, pp. 614-615.
D'Amico et al., "Determinants of prostate cancer-specific survival after radiation therapy for patients with clinically localized prostate cancer," J Clin Oncol. (2002) 20:4567-4573.
De Klein et al., "A cellular oncogene is translocated to the Philadelphia chromosome in chronic myelocytic leukaemia." Nature (Dec. 23, 1982) 300(5894):765-7.
De Marzo et al., "Pathological and molecular mechanisms of prostate carcinogenesis: implications for diagnosis, detection, prevention, and treatment," J Cell Biochem. (Feb. 15, 2004) 91(3):459-477.
Den et al., Mar. 10, 2015, Genomic classifier indentifies men with adverse pathology after racial prostatectomy who benefit from adjuvant radiation therapy, Journal of Clinical Oncology, 33(8):944-951.
Edwards et al., "Expression analysis onto microarrays of randomly selected cDNA clones highlights HOXB13 as a marker of human prostate cancer," Br J Cancer. (Jan. 31, 2005) 92(2):376-381.
Epstein et al., "Prognostic factors and reporting of prostate carcinoma in radical AU prostatectomy and pelvic lymphadenectomy specimens," Scand. J. Urol. Nephrol. Suppl. (2005) 216:34-63.
Feng et al., "Luminal and basal subtyping of prostate cancer," *J Clin Oncol* (Feb. 20, 2017) vol. 35, No. 6, p. 3, Abstract.
Fine et al., "A Proportional Hazards Model for the Subdistribution of a Competing Risk," Journal of the American Statistical Association (1999) vol. 94 (446), pp. 496-509.
Fu et al., "Regulation of apoptosis by a prostate-specific and prostate cancer-associated noncoding gene, PCGEM1." DNA Cell Biol. (Mar. 2006) 25(3): 135-41.
Galavotti et al., Apr. 2012, The autophagy-associated factors DRAM1 and p62 regulate cell migration and invasion in glioblastoma stem cells, Oncogene, 32:699-712.
Garber et al., "Diversity of gene expression in adenocarcinoma of the lung," PNAS (Nov. 20, 2001) vol. 98, No. 24, pp. 13784-13789.
Gleason: "Histologic grading of prostate cancer: a perspective"; Hum. Pathol. (1992) 23(3):273-279.
Gleave et al., "Randomized comparative study of 3 versus 8-month neoadjuvant hormonal therapy before radical orostatectomy : biochemical and pathological effects," J Urol. (2001) 166:500-507.
Gonzalgo et al: "Molecular pathways to prostate cancer"; J Urol. (2003) 170(6 Pt 1):2444-2452.
Grambsch et al., "Proportional Hazards Tests and Diagnostics Based on Weighted Residuals," Biometrika (2013) vol. 81 (3), pp. 515-526.
Heagerty et al., "Time-Dependent ROC Curves for Censored Survival Data and a Diagnostic Marker," Biometrics (2000) vol. 56 (2), pp. 337-344.
Humphrey et al: "Histologic grade, DNA ploidy, and intraglandular tumor extent as indicators of tumor progression of clinical Stage B prostatic carcinoma"; Am J Surg Pathol (1991) 15(12):1165-1170.
Ida et al., "Topoisomerase II alpha protein expression is predictive of outcome in Gleason score 7 prostate cancer patients treated surgically and is dependent on ERG status." Mod Pathol. (Feb. 2010) Abstract 1895, 23 : 424A-425A.
Ito et al.,"Linkage of elevated ets-2 expression to hepatocarcinogenesis," Anticancer Research (2002) 22(4):2385-2389.
Jemal et al.: "Cancer statistics," CA Cancer J Clin. (2005) 55:10-30.

Jhavar et al., "Technical Advance: Detection of TMPRSS2-ERG Translocations in Human Prostate Cancer by Expression Profiling Using GeneChip Human Exon 1.0 ST Arrays," J Mol. Diag (Jan. 2008) vol. 10, No. 1, pp. 50-57.
Jones et al., "Frequent mutations of chromatin remodeling gene ARID1A in ovarian clear cell carcinoma" Science (Oct. 8, 2010) 330(6001):228-31.
Karan et al., "Current status of the molecular genetics of human prostatic adenocarcinomas," Int J Cancer, 2003, 103(3):285-293.
Karnes et al., "Radical prostatectomy for high-risk prostate cancer," Jpn. J. Clin. Oneal. (Oct. 19, 2009) 40 (1): 3-9, Epub.
Kestin, "Potential survival advantage with early androgen deprivation for biochemical failure after external beam radiotherapy: the importance of accurately defining biochemical disease status," Int J Rad Oncol Biol Phys. (2004) 60:453-62.
Kumar-Sinha et al., "Molecular markers to identify patients al risk for recurrence after primary treatment for prostate cancer," Urology, 62 Suppl 1:19-35, Dec. 29, 2003.
Kunarso et al., "Transposable elements have rewired the core regulatory network of human embryonic stem cells," Nat Genet (Jul. 2010) 42(7):631-4.
Lawton et al., "Updated results of the phase III Radiation Therapy Oncology Group (RTOG) trial 85-31 evaluating the potential benefit of androgen suppression following standard radiation therapy for unfavorable prognosis carcinoma of the prostate," Int J Rad Oncol Biol Phvs. (2001) 49:937-946.
Leyten et al., "Identification of a Candidate Gene Panel for the Early Diagnosis of Prostate Cancer," Clinical Cancer Research (2015) 21(13):3061-3070.
Lin et al., "Nuclear receptor-induced chromosomal proximity and DNA breaks underlie specific translocations in cancer," Cell (Dec. 11, 2009) 139(6):1069-83.
Liu et al., 2014, Synergistic killing of lung cancer cells by cisplatin and radiation via autophagy and apoptosis, Oncology Letters, 7:1903-1910.
Livingston et al., "*Homo sapiens* CDC20 Cell Division Cycle 20 Homolog (CDC20)," Gene (Apr. 24, 2006).
Luo et al., "Gene expression analysis of prostate cancers," Molecular Carcinogenesis (Jan. 2002) 33(1):25-35.
McConkey et al., Apr. 2015, Therapeutic opportunities in the intrinsic subtypes of muscle-invasive bladder cancer, Hematology/Oncology Clinics of North America, 29(2):377-394.
McConkey et al., May 2016, A prognostic gene expression signature in the molecular classification of chemotherapy-naïve urothelical cancer is predictive of clinical outcomes from neoadjuvant chemotherapy: a phase 2 trial of dose-dense methotrexate, vinblastine, doxorubicin, and cisplatin with bevacizumab in urothelial cancer, European Urology, 69(5):855-862.
Mitelman, "Recurrent chromosome aberrations in cancer," Mutation Research (2000) 462: 247-253.
Montironi et al., "Carcinoma of the prostate: inherited susceptibility, somatic gene defects and androgen receptors," Virchows Arch. (Jun. 2004) 444(6):503-508.
Moul et al., "Early versus delayed hormonal therapy for prostate specific antigen only recurrence of prostate cancer after radical prostatectomy," J Urol. (2004) 171:1141-1147.
Moul, "Prostate specific antigen only progression of prostate cancer," J Urol. (2000) 163:1632-42.
Ohl et al., "Gene expression studies in prostate cancer tissue: which reference gene should be selected for normalization?," J. Mol. Med . (2005) 83(12):1014-1024.
Oosumi et al., "Mariner transposons in humans", Nature (Dec. 14, 1995) 378 (6558): 672.
Ozen et al., Sep. 24, 2007, Widespread deregulation of microRNA expression in human prostate cancer, Oncogene, 27:1788-1793.
Paulo et al.,"Molecular Subtyping of Primary Prostate Cancer Reveals Specific and Shared Target Genes of Different ETS Rearrangements," *Neoplasia* (Jul. 2012) 14(7):600-611.
Porkka et al., "RAD21 and KIAA0196 at 8q24 are amplified and overexpressed in prostate cancer," Genes Chromosomes Cancer (2007) 39:1-10.

(56) References Cited

OTHER PUBLICATIONS

Probe Set Listing for the Affymetrix Human Genome U133 Plus 2.0 array (Accessed from https://www.affymetrix.com/analysis/index.affx on Jul. 1, 2015) (Year: 2015).
Rabbits, "Chromosomal translocations in human cancer", Nature (Nov. 10, 1994) 372: 143-149.
Roberts et al., "The SWI/SNF complex-chromatin and cancer." Nat Rev Cancer (Feb. 2004) 4(2):133-42.
Robertson et al., "Reconstructing the ancient mariners of humans." Nat Genet. (Apr. 1996) 12(4):360-1.
Romanuik et al., "LNCaP Atlas: Gene expression associated with in vivo progression to castration-recurrent prostate cancer," GMB Medical Genomics (2010) 3:43, pp. 1-19.
Ross et al., "Tissue-based Genomics Augments Post-prostatectomy Risk Stratification in a Natural History Cohort of Intermediate- and High-Risk Men," European Urology 69 (2016) pp. 157-165.
Rowley, "A new Consistent Chromosomal Abnormality in Chronic Myelogenous Leukaemia Identified by Quinacrine fluorescence and Giemsa Staining," Nature (Jun. 1, 1973) 243:290-293.
Rowley, "Chromosome translocations: dangerous liaisons revisited," Nature Reviews: Cancer (Dec. 2001) 1):245-250.
Saito-Hisaminato et al., "Genome-Wide Profiling of Gene Expression in 29 Normal Human Tissues with a cDNA Microarray," DNA Research (2002) vol. 9, pp. 35-45.
Saligan et al., "Supervised Classification by Filter Methods and Recursive Feature Elimination Predicts Rick of Radiotherapy-Related Fatigue in Patients with Prostate Cancer," Cancer Informatics (2014) 13: 141-152.
Sandler et al., "Overall survival after prostate-specific-antigen-detected recurrence following conformal radiation therapy," Int J Rad Oncol Biol Phys. (2000) 48:629-633.
Savinainen et al., "Expression and copy number analysis of TRPS 1, EIF3S3 and MYC genes in breast and prostate cancer," Br J Cancer (2004) 90: 1041-1046.
Schmidt et al., "Lack of interferon consensus sequence binding protein (ICSBP) transcripts in human myeloid leukemias," Blood (1998) 91:22-29.
Seiler et al., Oct. 2017, Impact of molecular subtypes in muscle-invasive bladder cancer on predicting response and survival after neoadjuvant chemotherapy, European Urology, 72(4):544-554.
Shen et al., "The SWI/SNF ATPase Brm is a gatekeeper of proliferative control in prostate cancer," Cancer Res. (Dec. 15, 2008) 68(24):10154-62.
Slotkin et al., "Transposable elements and the epigenetic regulation of the genome." Nat Rev Genet. (Apr. 2007) 8(4):272-85.
Smit et al., "High-Resolution ERG-Expression Profiling on GeneChip Exon 1.0 St Arrays in Primary and Castration-Resistant Prostate Cancer," BJU International (2013), 111(5):836-842, BJU International.
Solo et al., "Prevalence of prostate cancer (PC) clinical states (CS) in the United States: Estimates using a dynamic progression model," ASCO Annual Meeting, Journal of Clinical Oncology (May 20, 2011) vol. 29, No. 15, Abstract 4637.
Stamey et al., "Molecular genetic profiling of Gleason grade 415 prostate cancers compared to benign prostatichyperplasia," J Urol. (2001) 166(6):2171-2177.
Stavenhagen et al., "An ancient provirus has imposed androgen regulation on the adjacent mouse sex-limited protein Jene." Cell (Oct. 21, 1988) 55(2):247-54.
Stephenson et al., "Postoperative Nomogram Predicting the 10-Year Probability of Prostate Cancer Recurrence After Radical Prostatectomy," J Clin Oncol (2008) vol. 23 (28), pp. 7005-7012.
Thompson et al., "Is the GPSM scoring algorithm for patients with prostate cancer valid in the contemporary era?" J Urol. (Aug. 2007) vol. 178 (2), 459-463.
Tollefson et al., "Stratification of Patient Risk Based on Prostate-Specific Antigen Doubling Time After Radical Retropubic Prostatectomy," Mayo Clin Proc. (2007) 82:422-427.
Tomlins et al., "Integrative molecular concept modeling of prostate cancer progression," Nat Genet. (2007) 39:41-51.
Versteege et al., "Truncating mutations of hSNF5/INI1 in aggressive paediatric cancer." Nature (Jul. 9, 1998) 394 6689):203-6.
Visakorpi, "The molecular genetics of prostate cancer," Urology (2003) 62(5 Suppl 1):3-10.
Willman et al., "Immunohistochemical staining for DNA topoisomerase II-alpha in benign, premalignant, and malignant lesions of the prostate," Prostate (Mar. 1, 2000) 42(4):280-286.
Winkler et al.: "Stage D1 prostatic adenocarcinoma: significance of nuclear DNA ploidy patterns studied by flow cytometry," Mayo Clin Proc. (1988) 63(2): 103-112.
Wyatt et al., "Heterogeneity in the inter-tumor transcriptome of high risk prostate cancer," Genome Biology (Aug. 26, 2014) vol. 15, No. 8, pp. 2-14.
Yeager et al., "Genome-wide association study of prostate cancer identifies a second risk locus at 8q24," Nat Genet (2007) 39:645-649.
Yeliin et al., "Widespread occurrence of antisense transcription in the human genome," Nat Biotechnol. (2003) 21(4):379-86.
Zanetta et al., "Flow-cytometric analysis of deoxyribonucleic acid content in advanced ovarian carcinoma: its importance in long-term survival," Am J Obstet Gynecol (1996) 175(5): 1217-1225.
Zelefsky et al., "High dose radiation delivered by intensity modulated conformal radiotherapy improves the outcome of localized prostate cancer," The Journal of Urology (Sep. 2001) 166(3):876-881.

* cited by examiner

SYSTEMS AND METHODS FOR EXPRESSION-BASED DISCRIMINATION OF DISTINCT CLINICAL DISEASE STATES IN PROSTATE CANCER

CROSS-REFERENCE TO RELATED APPLICATIONS

This application is a continuation of U.S. application Ser. No. 12/994,408 filed Feb. 17, 2011, now abandoned, which claimed the benefit of 5 USC § 371 National Stage application of International Application No. PCT/CA2009/000694 filed May 28, 2009, which claims priority benefit of U.S. 61/056,827 filed May 28, 2008, now expired. The disclosure of each of the prior applications is considered part of and is incorporated by reference in the disclosure of this application.

INCORPORATION OF SEQUENCE LISTING

The material in the accompanying sequence listing is hereby incorporated by reference into this application. The accompanying sequence listing text file, name GBX1140_2_Sequence_Listing.txt, was created on Jun. 22, 2016, and is 744 kb. The file can be assessed using Microsoft Word on a computer that uses Windows OS.

FIELD OF THE INVENTION

This invention relates to the field of diagnostics and in particular to systems and methods for classifying prostate cancer into distinct clinical disease states.

BACKGROUND

Prostate cancer is the most common malignancy affecting U.S. men, with approximately 240,000 new cases diagnosed each year. The incidence of prostate cancer is increasing, in part due to increased surveillance efforts from the application of routine molecular testing such as prostate specific antigen (PSA). For most men, prostate cancer is a slow-growing, organ-confined or localized malignancy that poses little risk of death. The most common treatments for prostate cancer in the U.S. are surgical procedures such as radical prostatectomy, where the entire prostate is removed from the patient. This procedure on its own is highly curative for most but not all men.

The vast majority of deaths from prostate cancer occur in patients with metastasis, believed to be present already at the time of diagnosis in the form of clinically undetectable micro-metastases. In these patients, it is clear that prostatectomy alone is not curative and additional therapies such as anti-androgen or radiation therapy are required to control the spread of disease and extend the life of the patient.

Most prostatectomy patients however face uncertainty with respect to their prognosis after surgery: whether or not the initial surgery will be curative several years from the initial treatment because the current methods for assessment of the clinical risk such as the various pathological (e.g., tumor stage), histological (e.g., Gleason's), clinical (e.g., Kattan nomogram) and molecular biomarkers (e.g., PSA) are not reliable predictors of prognosis, specifically disease progression. Routine PSA testing has certainly increased surveillance and early-detection rates of prostate cancer and this has resulted in an increased number of patients being treated but not significantly decreased the mortality rate.

Despite the controversies surrounding PSA testing as a screening tool, most physicians confidently rely on PSA testing to assess pre-treatment prognosis and to monitor disease progression after initial therapy. Successive increases in PSA levels above a defined threshold value or variations thereof (i.e. 'Rising-PSA'), also known as biochemical recurrence has been shown to be correlated to disease progression after first-line therapy (e.g., prostatectomy, radiation and brachytherapy). However, less than a ⅓ of patients with 'rising-PSA' will eventually be diagnosed with systemic or metastatic disease and several studies have shown that after long-term follow up, the majority will never show any symptoms of disease progression aside from increases in PSA measurement. The limitations of using the PSA biomarker and the absence of additional biomarkers for predicting disease recurrence have led to the development of statistical models combining several clinical and pathological features including PSA results. Several of these 'nomograms' have been shown to improve the predictive power for disease recurrence in individual patients over any single independent variable. These models (see Citation #14) are used routinely in the clinic and are currently the best available tools for prediction of outcomes, although they do not provide high levels of accuracy for groups of patients with highly similar histological/pathological features or those at 'intermediate' risk of disease recurrence after prostatectomy.

The use of quantitative molecular analyses has the potential to increase the sensitivity, specificity and/or overall accuracy of disease prognosis and provide a more objective basis for determination of risk stratification as compared to conventional clinical-pathological risk models (see Citation #13). The PSA test demonstrates the deficiencies of relying on the measurement of any single biomarker in clinically heterogeneous and complex prostate cancer genomes. Therefore, genomic-based approaches measuring combinations of biomarkers or a signature of disease recurrence are currently being investigated as better surrogates for predicting disease outcome (see Citations # 1-13). For prostate cancer patients these efforts are aimed at reducing the number of unnecessary surgeries for patients without progressive disease and avoid inadvertent under-treatment for higher risk patients. To date, genomic profiling efforts to identify DNA-based (e.g., copy-number alterations, methylation changes), RNA-based (e.g., gene or non-coding RNA expression) or protein-based (e.g., protein expression or modification) signatures, useful for disease prognosis have not however resulted in widespread clinical use.

There are several key reasons explaining why prior genomic profiling methods for prostate cancer have not yet been incorporated in the clinic. These include the small sample sizes typical of individual studies, coupled with variations due to differences in study protocols, clinical heterogeneity of patients and lack of external validation data, which combined have made identifying a robust and reproducible disease signature elusive. Specifically for gene or RNA expression based prognostic models; the mitigating technological limitations include the quality and quantity of RNA that can be isolated from routine clinical samples. Routine clinical samples of prostate cancer include needle-biopsies and surgical resections that have been fixed in formalin and embedded in paraffin wax (FFPE). FFPE-derived RNA is typically degraded and fragmented to between 100-300 by in size and without poly-A tails making it of little use for traditional 3'-biased gene expression profiling, which requires larger microgram quantities of RNA with intact poly-A tails to prime cDNA synthesis.

Furthermore, as <2% of the genome encodes for protein, traditional gene expression profiling in fact captures only a small fraction of the transcriptome and variation in expression as most RNA molecules that are transcribed are not translated into protein but serve other functional roles and non-coding RNAs are the most abundant transcript species in the genome.

This background information is provided for the purpose of making known information believed by the applicant to be of possible relevance to the present invention. No admission is necessarily intended, nor should be construed, that any of the preceding information constitutes prior art against the present invention.

SUMMARY OF THE INVENTION

An object of the present invention is to provide systems and methods for expression-based discrimination of distinct clinical disease states in prostate cancer. In accordance with one aspect of the present invention, there is provided a system for expression-based assessment of risk of prostate cancer recurrence after prostatectomy, said system comprising one or more polynucleotides, each of said polynucleotides capable of specifically hybridizing to a RNA transcript of a gene selected from the group of genes set forth in Table 3 and/or 6.

In accordance with another aspect of the present invention, there is provided a nucleic acid array for expression-based assessment of prostate cancer recurrence risk, said array comprising at least ten probes immobilized on a solid support, each of said probes being between about 15 and about 500 nucleotides in length, each of said probes being derived from a sequence corresponding to, or complementary to, a transcript of a gene selected from the group of genes set forth in Table 3 and/or 6, or a portion of said transcript.

In accordance with another aspect of the present invention, there is provided a method for expression-based assessment of prostate cancer recurrence, said method comprising: (a) determining the expression level of one or more transcripts of one or more genes in a test sample obtained from said subject to provide an expression pattern profile, said one or more genes selected from the group of genes set forth in Table 3 and/or 6, and (c) comparing said expression pattern profile with a reference expression pattern profile.

In accordance with another aspect of the present invention, there is provided a kit for characterizing the expression of one or more nucleic acid sequences depicted in SEQ ID NOs: 1-2114 comprising one or more nucleic acids selected from (a) a nucleic acid depicted in any of SEQ ID NOs: 1-2114; (b) an RNA form of any of the nucleic acids depicted in SEQ ID NOs: 1-2114; (c) a peptide nucleic acid form of any of the nucleic acids depicted in SEQ ID NOs: 1-2114; (d) a nucleic acid comprising at least 20 consecutive bases of any of (a-c); (e) a nucleic acid comprising at least 25 consecutive bases having at least 90% sequence identity to any of (a-c); or (f) a complement to any of (a-e); and optionally instructions for correlating the expression level of said one or more nucleic acid sequences with the disease state of prostate cancer tissue.

In accordance with another aspect of the present invention, there is provided an array of probe nucleic acids certified for use in expression-based assessment of prostate cancer recurrence risk, wherein said array comprises at least two different probe nucleic acids that specifically hybridize to corresponding different target nucleic acids depicted in one of SEQ ID NOs: 1-2114, an RNA form thereof, or a complement to either thereof.

In accordance with another aspect of the present invention, there is provided a device for classifying a biological sample from a prostate cancer as recurrent or non-recurrent, the device comprising means for measuring the expression level of one or more transcripts of one or more genes selected from the group of genes set forth in Table 3 and/or 6; means for correlating the expression level with a classification of prostate cancer status; and means for outputting the prostate cancer status.

In accordance with another aspect of the present invention, there is provided a computer-readable medium comprising one or more digitally-encoded expression pattern profiles representative of the level of expression of one or more transcripts of one or more genes selected from the group of genes set forth in Table 3 and/or 6, each of said one or more expression pattern profiles being associated with a value wherein each of said values is correlated with the presence of recurrent or non-recurrent prostate cancer.

BRIEF DESCRIPTION OF THE DRAWINGS

These and other features of the invention will become more apparent in the following detailed description in which reference is made to the appended drawings.

DETAILED DESCRIPTION OF THE INVENTION

Figure 1A:
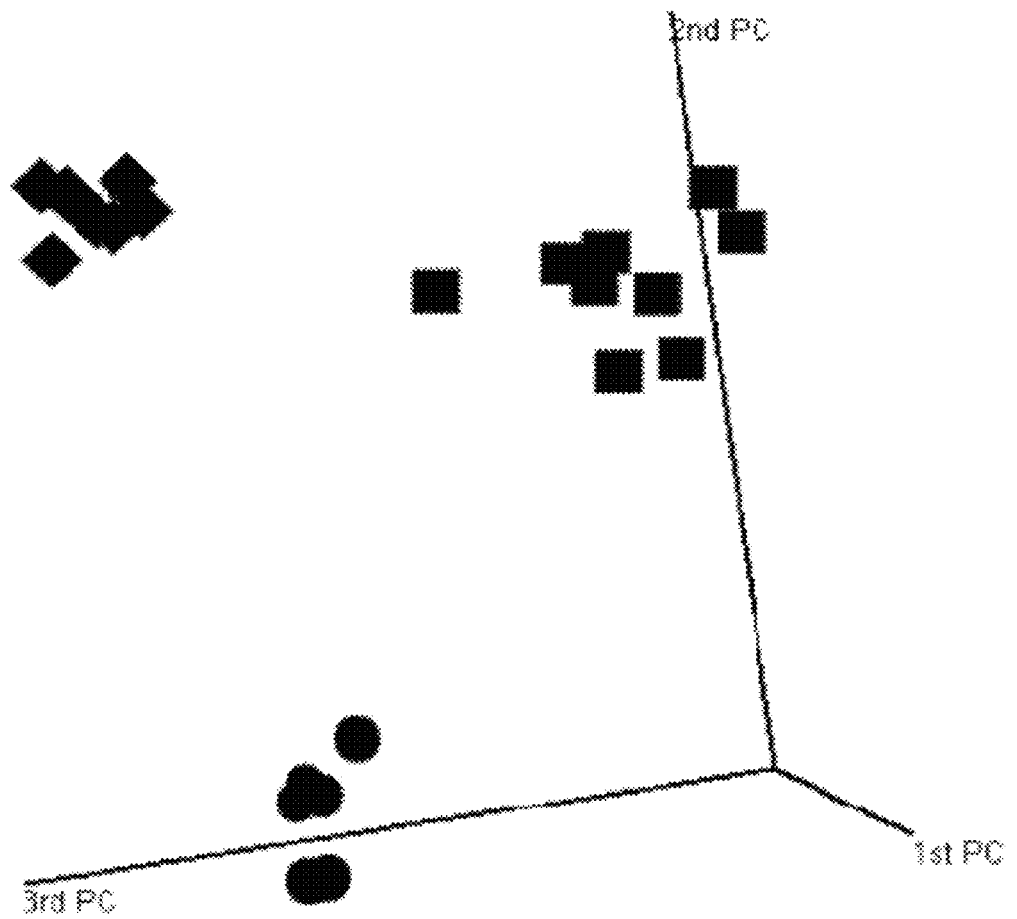
FIGS. 1A-C. A) Principle components analysis (PCA) of 2,114 RNAs identified to be differentially expressed between tumors from patients with differing clinical outcome (see Table 2 for 20 comparisons evaluated), PCA plot of 22 prostate cancer tumors shows tight clustering of samples by clinical outcome of patients (circles, NED; diamonds, PSA; squares, SYS). B) Two-way hierarchical clustering dendrogram and expression matrix of 526 target sequences (Table 4) RNAs filtered using linear regression ($p<0.01$) to identify RNAs that followed either SYS>PSA>NED or NED>PSA>SYS trend in differential expression. C) Two-way hierarchical clustering dendrogram and expression matrix of 148 target sequences (Table 5), a subset of the most differentially expressed transcripts between patients with clinically significant 'recurrent' (i.e., 'SYS') and 'non-recurrent' (i.e., 'PSA' and 'NED') disease as filtered using a t-test ($p<0.001$). For B) and C), sample and RNAs were optimally ordered using Pearson's correlation distance metric with complete-linkage cluster distances and the expression of each RNA in each sample was normalized in the heatmap by the number of standard deviations above (blacker) and below (whiter) the median expression value (grey) across all samples.

The present invention provides a system and method for assessing prostate cancer recurrence risk by distinguishing clinically distinct disease states in men with prostate cancer at the time of initial diagnosis or surgery. The system and methods are based on the identification of gene transcripts following a retrospective analysis of tumor samples that are differentially expressed in prostate cancer in a manner dependent on prostate cancer aggressiveness as indicated by long-term post-prostatectomy clinical outcome. These gene transcripts can be considered as a library which can be used as a resource for the identification of sets of specific target sequences ("prostate cancer prognostic sets"), which may represent the entire library of gene transcripts or a subset of the library and the detection of which is indicative of prostate cancer recurrence risk. The invention further provides for probes capable of detecting these target sequences and primers that are capable of amplifying the target sequences.

In accordance with one embodiment of the invention, the system and method for assessing prostate cancer recurrence risk are prognostic for a post surgery clinical outcome selected from no evidence of disease ('NED'), biochemical relapse (two successive increases in prostate-specific antigen levels; ('PSA') and systemic prostate cancer systemic metastases ('SYS').

In accordance with one embodiment of the invention, the target sequences comprised by the prostate cancer prognostic set are sequences based on or derived from the gene transcripts from the library, or a subset thereof. Such sequences are occasionally referred to herein as "probe selection regions" or "PSRs." In another embodiment of the invention, the target sequences comprised by the prostate classification set are sequences based on the gene transcripts from the library, or a subset thereof, and include both coding and non-coding sequences.

In one embodiment, the systems and methods provide for the molecular analysis of the expression levels of one or more of the target sequences as set forth in SEQ ID NOs: 1-2114 (Table 4). Increased relative expression of one or more target sequences in a 'NED' Group corresponding to the sequences as set forth in SEQ ID NOs: 1-913 is indicative of or predictive of a non-recurrent form of prostate cancer and can be correlated with an increased likelihood of a long-term NED prognosis or low risk of prostate cancer recurrence. Increased relative expression of one or more target sequences in a 'SYS' Group corresponding to the sequences as set forth in SEQ ID NOs: 914-2114 is indicative of or predictive of an aggressive form of prostate cancer and can be correlated with an increased likelihood of a long-term SYS prognosis or high risk of prostate cancer recurrence. Optionally, intermediate relative levels of one or more target sequences in a 'PSA' Group corresponding to target sequences set forth in Table 7 is indicative of or predictive of biochemical recurrence. Subsets and combinations of these target sequences or probes complementary thereto may be used as described herein.

Before the present invention is described in further detail, it is to be understood that this invention is not limited to the particular methodology, compositions, articles or machines described, as such methods, compositions, articles or machines can, of course, vary. It is also to be understood that the terminology used herein is for the purpose of describing particular embodiments only, and is not intended to limit the scope of the present invention.

Definitions

Unless defined otherwise or the context clearly dictates otherwise, all technical and scientific terms used herein have the same meaning as commonly understood by one of ordinary skill in the art to which this invention belongs. In describing the present invention, the following terms will be employed, and are intended to be defined as indicated below.

The term "polynucleotide" as used herein refers to a polymer of greater than one nucleotide in length of ribonucleic acid (RNA), deoxyribonucleic acid (DNA), hybrid RNA/DNA, modified RNA or DNA, or RNA or DNA mimetics, including peptide nucleic acids (PNAs). The polynucleotides may be single- or double-stranded. The term includes polynucleotides composed of naturally-occurring nucleobases, sugars and covalent internucleoside (backbone) linkages as well as polynucleotides having non-naturally-occurring portions which function similarly. Such modified or substituted polynucleotides are well-known in the art and for the purposes of the present invention, are referred to as "analogues."

"Complementary" or "substantially complementary" refers to the ability to hybridize or base pair between nucleotides or nucleic acids, such as, for instance, between a sensor peptide nucleic acid or polynucleotide and a target polynucleotide. Complementary nucleotides are, generally, A and T (or A and U), or C and G. Two single-stranded polynucleotides or PNAs are said to be substantially complementary when the bases of one strand, optimally aligned and compared and with appropriate insertions or deletions, pair with at least about 80% of the bases of the other strand, usually at least about 90% to 95%, and more preferably from about 98 to 100%.

Alternatively, substantial complementarity exists when a polynucleotide will hybridize under selective hybridization conditions to its complement. Typically, selective hybridization will occur when there is at least about 65% complementarity over a stretch of at least 14 to 25 bases, for example at least about 75%, or at least about 90% complementarity. See, M. Kanehisa Nucleic Acids Res. 12:203 (1984).

"Preferential binding" or "preferential hybridization" refers to the increased propensity of one polynucleotide to bind to its complement in a sample as compared to a noncomplementary polymer in the sample.

Hybridization conditions will typically include salt concentrations of less than about 1M, more usually less than about 500 mM, for example less than about 200 mM. In the case of hybridization between a peptide nucleic acid and a polynucleotide, the hybridization can be done in solutions containing little or no salt. Hybridization temperatures can be as low as 5° C., but are typically greater than 22° C., and more typically greater than about 30° C., for example in excess of about 37° C. Longer fragments may require higher hybridization temperatures for specific hybridization as is known in the art. Other factors may affect the stringency of hybridization, including base composition and length of the complementary strands, presence of organic solvents and extent of base mismatching, and the combination of parameters used is more important than the absolute measure of any one alone. Other hybridization conditions which may be controlled include buffer type and concentration, solution pH, presence and concentration of blocking reagents to decrease background binding such as repeat sequences or blocking protein solutions, detergent type(s) and concentrations, molecules such as polymers which increase the relative concentration of the polynucleotides, metal ion(s) and their concentration(s), chelator(s) and their concentrations, and other conditions known in the art.

"Multiplexing" herein refers to an assay or other analytical method in which multiple analytes can be assayed simultaneously.

A "target sequence" as used herein (also occasionally referred to as a "PSR" or "probe selection region") refers to a region of the genome against which one or more probes can be designed. As used herein, a probe is any polynucleotide capable of selectively hybridizing to a target sequence or its complement, or to an RNA version of either. A probe may comprise ribonucleotides, deoxyribonucleotides, peptide nucleic acids, and combinations thereof. A probe may optionally comprise one or more labels. In some embodiments, a probe may be used to amplify one or both strands of a target sequence or an RNA form thereof, acting as a sole primer in an amplification reaction or as a member of a set of primers.

"Having" is an open ended phrase like "comprising" and "including," and includes circumstances where additional elements are included and circumstances where they are not.

"Optional" or "optionally" means that the subsequently described event or circumstance may or may not occur, and that the description includes instances where the event or circumstance occurs and instances in which it does not.

As used herein 'NED' describes a clinically distinct disease state in which patients show no evidence of disease ('NED') at least 5 years after surgery, TSA' describes a clinically distinct disease state in which patients show biochemical relapse only (two successive increases in prostate-specific antigen levels but no other symptoms of disease with at least 5 years follow up after surgery; 'PSA') and 'SYS' describes a clinically distinct disease state in which patients develop biochemical relapse and present with systemic prostate cancer disease or metastases ('SYS') within five years after the initial treatment with radical prostatectomy.

As used herein, the term "about" refers to approximately a +/−10% variation from a given value. It is to be understood that such a variation is always included in any given value provided herein, whether or not it is specifically referred to.

Use of the singular forms "a," "an," and "the" include plural references unless the context clearly dictates otherwise. Thus, for example, reference to "a polynucleotide" includes a plurality of polynucleotides, reference to "a target" includes a plurality of such targets, reference to "a normalization method" includes a plurality of such methods, and the like. Additionally, use of specific plural references, such as "two," "three," etc., read on larger numbers of the same subject, unless the context clearly dictates otherwise.

Terms such as "connected," "attached," "linked" and "conjugated" are used interchangeably herein and encompass direct as well as indirect connection, attachment, linkage or conjugation unless the context clearly dictates otherwise.

Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention, as are ranges based thereon. Where a combination is disclosed, each subcombination of the elements of that combination is also specifically disclosed and is within the scope of the invention. Conversely, where different elements or groups of elements are disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

PROSTATE CANCER PROGNOSTIC SYSTEM

The system of the present invention is based on the identification of a library of gene and RNA transcripts that are differentially expressed in prostate cancer in a manner dependent on prostate cancer aggressiveness as indicated by the post-prostatectomy clinical outcome of the patient. For example, relative over expression of one or more of the gene transcripts in a prostate cancer sample compared to a reference sample or expression profile or signature there from may be prognostic of a clinically distinct disease outcome post-prostatectomy selected from no evidence of disease ('NED'), biochemical relapse ('PSA') and prostate cancer disease systemic recurrence or metastases ('SYS'). The reference sample can be, for example, from prostate cancer sample(s) of one or more references subject(s) with a known post-prostatectomy clinical outcomes. The reference expression profile or signature may optionally be normalized to one or more appropriate reference gene transcripts. Alternatively or in addition to, expression of one or more of the gene transcripts in a prostate cancer sample may be compared to an expression profile or signature from normal prostate tissue.

Expression profiles or signatures from prostate cancer samples may be normalized to one or more house keeping gene transcripts such that normalized over and/or under expression of one or more of the gene transcripts in a sample may be indicative of a clinically distinct disease state or prognosis.

Prostate Prognostic Library

The Prostate Prognostic Library in accordance with the present invention comprises one or more gene or RNA transcripts whose relative and/or normalized expression is indicative of prostate cancer recurrence and which may be prognostic for post-prostatectomy clinical outcome of a patient. Exemplary RNA transcripts that showed differential expression in prostate cancer samples from patients with clinically distinct disease outcomes after initial treatment with radical prostatectomy are shown in Table 3. In one embodiment of the invention, the library comprises one or more of the gene transcripts of the genes listed in Table 3.

In one embodiment, the library comprises at least one transcript from at least one gene selected from those listed in Table 3. In one embodiment, the library comprises at least one transcript from each of at least 5 genes selected from those listed in Table 3. In another embodiment, the library comprises at least one transcript from each of at least 10 genes selected from those listed in Table 3. In a further embodiment, the library comprises at least one transcript from each of at least 15 genes selected from those listed in Table 1. In other embodiments, the library comprises at least one transcript from each of at least 20, at least 25, at least 30, at least 35, at least 40, at least 45, at least 50, at least 55, at least 60 and at least 65 genes selected from those listed in Table 3. In a further embodiment, the library comprises at least one transcript from all of the genes listed in Table 3. In a further embodiment, the library comprises at all transcripts from all of the genes listed in Table 3.

In one embodiment, the library comprises at least one transcript from at least one gene selected from the group consisting of [NM_001004722]; [NM_001005522]; [NM_001013671]; [NM_001033517]; [NM_183049]; [NM_212559]; 5'-3' exoribonuclease 1; A kinase (PRKA) anchor protein (yotiao) 9; AarF domain containing kinase 4; Abhydrolase domain containing 3; Aconitase 1, soluble; Actinin, alpha 1; ADAM metallopeptidase domain 19 (meltrin beta); Adaptor-related protein complex 1, gamma 2 subunit; Adenosine deaminase, RNA-specific, B2 (RED2 homolog rat); Adenylate cyclase 3; ADP-ribosylation factor GTPase activating protein 3; ADP-ribosylation factor guanine nucleotide-exchange factor 2 (brefeldin A-inhibited); ADP-ribosylation factor-like 4D; Adrenergic, beta, receptor kinase 2; AF4/FMR2 family, member 3; Amyloid beta (A4) precursor protein-binding, family B, member 1 (Fe65); Anaphase promoting complex subunit 1; Ankyrin 3, node of Ranvier (ankyrin G); Ankyrin repeat domain 15; Ankyrin repeat domain 28; Annexin Al; Annexin A2; Anterior pharynx defective 1 homolog B (C. elegans);Anthrax toxin receptor 1; Antizyme inhibitor 1; Arachidonate 12-lipoxygenase, 12R type; Arginine vasopressin receptor 1A; Arginine-glutamic acid dipeptide (RE) repeats; ARP3 actin-related protein 3 homolog (yeast); Arrestin 3, retinal (X-arrestin); Arrestin domain containing 1; Aryl hydrocarbon receptor interacting protein-like 1; Aryl hydrocarbon receptor nuclear translocator; Ataxin 1; ATM/ATR-Substrate Chk2-Interacting Zn2+-finger protein; ATPase, Class I, type 8B, member 1; ATPase, Na+/K+ transporting, alpha 1 polypeptide; ATP-binding cassette, sub-family F (GCN20), member 1; Autism susceptibility candidate 2; Baculoviral IAP repeat-containing 6 (apollon); Basonuclin 2; Brain-specific angiogenesis inhibitor 3; Bromodomain containing 7; Bromodomain containing 8; Bromodomain PHD finger transcription factor; BTB (POZ) domain containing 16; -BTB (POZ) domain containing 7; Calcium activated nucleotidase 1; Calcium binding protein P22; Calcium channel, voltage-dependent, beta 4 subunit; Calcium channel, voltage-dependent, L type, alpha 1C subunit; Calcium channel, voltage-dependent, L type, alpha 1D subunit; Calcyclin binding protein; Calmodulin 1 (phosphorylase kinase, delta); Calsyntenin 1; Carbonyl reductase 3; Cardiolipin synthase 1; Carnitine palmitoyltransferase 1A (liver); Casein kinase 1, delta; Casein kinase 1, gamma 1; Casein kinase 1, gamma 3; Caspase 1, apoptosis-related cysteine peptidase (interleukin 1, beta, convertase); CD109 molecule; CD99 molecule-like 2; CDK5 regulatory subunit associated protein 2; CDP-diacylglycerol synthase (phosphatidate cytidylyltransferase) 2; Cell adhesion molecule 1; Cell division cycle and apoptosis regulator 1; Centrosomal protein 70 kDa; Chloride channel 3; Chromodomain helicase DNA binding protein 2; Chromodomain helicase DNA binding protein 6; Chromodomain protein, Y-like 2; Chromosome 1 ORF 116; Chromosome 1 ORF 52; Chromosome 10 ORF 118; Chromosome 12 ORF 30; Chromosome 13 ORF 23; Chromosome 16 ORF 45; Chromosome 18 ORF 1; Chromosome 18 ORF 1; Chromosome 18 ORF 1; Chromosome 18 ORF 1; Chromosome 18 ORF 17; Chromosome 2 ORF 3; Chromosome 20 ORF 133; Chromosome 21 ORF 25; Chromosome 21 ORF 34; Chromosome 22 ORF 13; Chromosome 3 ORF 26; Chromosome 5 ORF 3; Chromosome 5 ORF 33; Chromosome 5 ORF 35; Chromosome 5 ORF 39; Chromosome 7 ORF 13; Chromosome 7 ORF 42; Chromosome 9 ORF 3; Chromosome 9 ORF 94; Chromosome Y ORF 15B; Chymase 1, mast cell; Citrate lyase beta like; Class II, major histocompatibility complex, transactivator; C-Maf-inducing protein; Coatomer protein complex, subunit alpha; Cofilin 2 (muscle); Coiled-coil domain containing 50; Coiled-coil domain containing 7; Coiled-coil-helix-coiled-coil-helix domain containing 4; Cold shock domain containing El, RNA-binding; Collagen, type XII, alpha 1; Complement component 1, r subcomponent-like; Core-binding factor, runt domain, alpha subunit 2; translocated to, 2; CREB binding protein (Rubinstein-Taybi syndrome); CTD (carboxy-terminal domain, RNA polymerase II, polypeptide A) small phosphatase 2; CTD (carboxy-terminal domain, RNA polymerase II, polypeptide A) small phosphatase-like; CUG triplet repeat, RNA binding protein 2; Cullin 3; Cut-like 2; Cyclin F; Cyclin Y; Cysteine-rich with EGF-like domains 1; Cytochrome P450, family 4, subfamily F, polypeptide 11; Cytoplasmic FMR1 interacting protein 2; DAZ interacting protein 1-like; DCP2 decapping enzyme homolog (S. cerevisiae); DEAD box polypeptide 47; DEAD box polypeptide 5; DEAD box polypeptide 52; DEAD box polypeptide 56; Death inducer-obliterator 1; Dedicator of cytokinesis 2; DEP domain containing 1B; DEP domain containing 2; DEP domain containing 6; Development and differentiation enhancing factor 1; Diacylglycerol lipase, alpha; Diaphanous homolog 2 (Drosophila); Dickkopf homolog 3; Dihydropyrimidine dehydrogenase; Dipeptidyl peptidase 10; Discs, large homolog 2, chapsyn-110; Dishevelled, dsh homolog 2; DnaJ (Hsp40) homolog, subfamily C, member 6; Dpy-19-like 3; Dual specificity phosphatase 5; Ectodysplasin A receptor; Ectonucleoside triphosphate diphosphohydrolase 7; EGFR-coamplified and overexpressed protein; ELL associated factor 1; Emopamil binding protein (sterol isomerase); Enabled homolog; Ephrin-A5; ER lipid raft associated 1; Erythroblast membrane-associated protein (Scianna blood group); Erythrocyte membrane protein band 4.1 like 4A; Etoposide induced 2.4 mRNA; Eukaryotic translation initiation factor 4E family member 3; FAD1 flavin adenine dinucleotide synthetase homolog; Family with sequence similarity 110, member A; Family with sequence similarity 114, member A1; Family with sequence similarity 135, member A; Family with sequence similarity 40, member A; Family with sequence similarity 80, member B; F-box and leucine-rich repeat protein 11; F-box and leucine-rich repeat protein 7; F-box protein 2; Ferritin, heavy polypeptide 1; Fibronectin type III domain containing 3A; Fibronectin type III domain containing 3B; Fibulin 1; FLJ25476 protein; FLJ41603 protein; Forkhead box J3; Forkhead box J3; Forkhead box K1; Forkhead box P1; Frizzled homolog 3; Frizzled homolog 5; G protein-coupled receptor kinase interactor 2; GABA A receptor, delta; GATA binding protein 2; GDNF family receptor alpha 2; Gelsolin (amyloidosis, Finnish type); Genethonin 1; Glucose phosphate isomerase; Glucose-fructose oxidoreductase domain containing 1; Glucosidase, beta (bile acid) 2; Glutamate dehydrogenase 1; Glutaminase; Glutamyl aminopeptidase (aminopeptidase A); Glutathione reductase Glycogen synthase kinase 3 beta; Grainyhead-like 2; Gremlin 1, cysteine knot superfamily, homolog; GTPase activating protein (SH3 domain) binding protein 1; Hairy/enhancer-of-split related with YRPW motif 2; Heparan sulfate 6-O-sulfotransferase 3; Hermansky-Pudlak syndrome 5; Heterogeneous nuclear ribonucleoprotein C (C1/C2)

Hippocalcin-like 1; Histocompatibility (minor) 13; Histone cluster 1, H3d; Histone deacetylase 6; Homeobox A1; Homeobox and leucine zipper encoding; Host cell factor C1 (VP16-accessory protein); Hyaluronan binding protein 4; Hyperpolarization activated cyclic nucleotide-gated potassium channel 3; Hypothetical gene supported by AK128346; Hypothetical LOC51149; Hypothetical protein FLJ12949; Hypothetical protein FLJ20035; Hypothetical protein FLJ20309; Hypothetical protein FLJ38482; Hypothetical protein HSPC148; Hypothetical protein LOC130576; Hypothetical protein LOC285908; Hypothetical protein LOC643155; Iduronidase, alpha-L-IKAROS family zinc finger 1 (Ikaros); IlvB (bacterial acetolactate synthase)-like; Inhibitor of kappa light polypeptide gene enhancer in B-cells, kinase beta; Inositol polyphosphate-4-phosphatase, type II; Integrin, alpha 4 (antigen CD49D, alpha 4 subunit of VLA-4 receptor); Integrin, alpha 6; Integrin, alpha 9; Integrin, alpha V (vitronectin receptor, alpha polypeptide, antigen CD51); Integrin, beta-like 1 (with EGF-like repeat domains); Inter-alpha (globulin) inhibitor H3; Interleukin enhancer binding factor 3, 90kDa; Intestine-specific homeobox Intraflagellar transport 172 homolog; Janus kinase 1; Jumonji domain containing 1B; Jumonji domain containing 2B; Jumonji domain containing 2C; Kalirin, RhoGEF kinase; Kallikrein-related peptidase 2; Karyopherin alpha 3 (importin alpha 4); Keratinocyte associated protein 2; KIAA0152; KIAA0241; KIAA0319-like; KIAA0495; KIAA0562; KIAA0564 protein; KIAA1217; KIAA1244; KIAA1244; La ribonucleoprotein domain family, member 1; Lamin A/C; LATS, large tumor suppressor, homolog 2; Leiomodin 3 (fetal); Leptin receptor overlapping transcript-like 1; Leucine rich repeat containing 16; Leucine-rich repeat kinase 1; Leucine-rich repeat-containing G protein-coupled receptor 4; LIM domain 7; Major histocompatibility complex, class II, DR beta 1; Malignant fibrous histiocytoma amplified sequence 1; Maltase-glucoamylase (alpha-glucosidase); Mannosidase, alpha, class 2A, member 1; Mannosyl (alpha-1,6-)-glycoprotein beta-1,6-N-acetyl-glucosaminyltransferase; MBD2-interacting zinc finger; Melanin-concentrating hormone receptor 1; Methionyl-tRNA synthetase; Methyl CpG binding protein 2; Methyl-CpG binding domain protein 5; Microcephaly, primary autosomal recessive 1; Microseminoprotein, beta-; Microtubule-associated protein 1B; Microtubule-associated protein 2; Minichromosome maintenance complex component 3 associated protein; Mitochondrial ribosomal protein S15; Mohawk homeobox; Monooxygenase, DBH-like 1; MORN repeat containing 1; Muscle RAS oncogene homolog; Muscleblind-like; Myelin protein zero-like 1; Myeloid/lymphoid or mixed-lineage leukemia (trithorax homolog, Drosophila); translocated to, 4; Myocyte enhancer factor 2B; Myosin IF; Myosin, heavy chain 3, skeletal muscle, embryonic; N-acetylgalactosaminidase, alpha-; N-acetylglucosamine-1-phosphate transferase, alpha and beta subunits; Nascent polypeptide-associated complex alpha subunit; NECAP endocytosis associated 2; Necdin homolog; Neural precursor cell expressed, developmentally down-regulated 9; Neuregulin 1; Neuron navigator 1; Nibrin; Nicotinamide N-methyltransferase; NIMA (never in mitosis gene a)-related kinase 6; NLR family, CARD domain containing 5; NOL1/NOP2/Sun domain family, member 3; NOL1/NOP2/Sun domain family, member 3; NOL1/NOP2/Sun domain family, member 6; Nuclear receptor coactivator 2; Nuclear receptor coactivator 6;Nuclear receptor subfamily 2, group F, member 2; Nuclear receptor subfamily 3, group C, member 2; Nuclear receptor subfamily 4, group A, member 2; Nuclear transcription factor, X-box binding-like 1; Nucleolar and coiled-body phosphoprotein 1; Overexpressed in colon carcinoma-1; PANS polyA specific ribonuclease subunit homolog; PAP associated domain containing 1; Paraoxonase 2; Paraspeckle component 1; PCTAIRE protein kinase 2; Peptidase D; Pericentrin (kendrin); Peroxisomal biogenesis factor 19; PHD finger protein 8; Phosphatidic acid phosphatase type 2 domain containing 3; Phosphatidylinositol 4-kinase, catalytic, alpha polypeptide; Phosphatidylinositol glycan anchor biosynthesis, class O; Phosphatidylinositol transfer protein, beta; Phosphodiesterase 4D, cAMP-specific; Phosphoglucomutase 5; Phosphoglycerate mutase family member 5; Phosphoinositide-3-kinase, class 2, beta polypeptide; Phospholipase A2, group IVB (cytosolic); Phospholipase C, beta 1 (phosphoinositide-specific); Phospholipase C, gamma 2 (phosphatidylinositol-specific);Phosphorylase kinase, beta; Plasminogen activator, tissue; Platelet-activating factor acetylhydrolase, isoform 1b, alpha subunit 45 kDa; Pleckstrin homology domain containing, family A (phosphoinositide binding specific) member 3; Pleckstrin homology domain containing, family A member 7; Pleckstrin homology domain containing, family G (with RhoGef domain) member 3; Pleckstrin homology domain containing, family H (with MyTH4 domain) member 1; Poly (ADP-ribose) polymerase family, member 16; Poly (ADP-ribose) polymerase family, member 2; Poly (A) polymerase alpha; Poly(A)-specific ribonuclease (deadenylation nuclease); Polymerase (DNA directed) nu; Polymerase (DNA directed), gamma 2, accessory subunit; Polymerase (RNA) II (DNA directed) polypeptide L; Polymerase (RNA) III (DNA directed) polypeptide E; Polymerase I and transcript release factor; Potassium channel tetramerisation domain containing 1; Potassium channel tetramerisation domain containing 2; Potassium channel tetramerisation domain containing 7; Potassium channel, subfamily K, member 1;Presenilin 1; PRKR interacting protein 1; Procollagen-lysine, 2-oxoglutarate 5-dioxygenase 2; ProSAPiP1 protein; Prostaglandin E synthase 3 (cytosolic); Protease, serine, 2 (trypsin 2); Protein kinase, Y-linked; Protein phosphatase 1, regulatory (inhibitor) subunit 9A; Protein phosphatase 3 (formerly 2B), catalytic subunit, alpha isoform; Protein phosphatase 4, regulatory subunit 1-like; Protein tyrosine phosphatase, non-receptor type 18 (brain-derived); Protein tyrosine phosphatase, non-receptor type 3; Protein tyrosine phosphatase, receptor type, D; Protein-O-mannosyltransferase 1; Proteolipid protein 2 (colonic epithelium-enriched); Protocadherin 7; Protocadherin gamma subfamily A, 1; PRP6 pre-mRNA processing factor 6 homolog; Putative homeodomain transcription factor 1; RAB GTPase activating protein 1-like; RAB10; RAB30; Rabaptin, RAB GTPase binding effector protein 1; RAD51-like 1; RALBP1 associated Eps domain containing 2; Rap guanine nucleotide exchange factor (GEF) 1; Rapamycin-insensitive companion of mTOR; Ras and Rab interactor 2; Receptor accessory protein 3; Reelin; Replication factor C (activator 1) 3; Replication protein A3; Rho GTPase activating protein 18; Rho guanine nucleotide exchange factor (GEF) 10-like; Rhophilin, Rho GTPase binding protein 1; Ribonuclease H2, subunit B; Ribonuclease P 14 kDa subunit; Ring finger protein 10; Ring finger protein 144; Ring finger protein 44; RNA binding motif protein 16; Roundabout, axon guidance receptor, homolog 1; Roundabout, axon guidance receptor, homolog 2; RUN domain containing 2A; Scinderin; SEC23 interacting protein; Sec61 alpha 2 subunit; Septin 11; Serine/threonine kinase 32A; Serine/threonine kinase 32C; SGT1, suppressor of G2 allele of SKP1; SH3 and PX domains 2A; Signal peptide peptidase 3; Signal transducer and activator of transcription 1, 91 kDa; Single-stranded DNA binding protein 2; Small nuclear ribonucleoprotein polypeptide N; SNF8, ESCRT-II complex subunit, homolog; Sodium channel, voltage-gated, type III, alpha subunit; Solute carrier family 1 (neutral amino acid transporter), member 5; Solute carrier family 16, member 7 (monocarboxylic acid transporter 2); Solute carrier family 2 (facilitated glucose transporter), member 11; Solute carrier family 2 (facilitated glucose transporter), member 11; Solute carrier family 24 (sodium/potassium/calcium exchanger), member 3; Solute carrier family 3 (activators of dibasic and neutral amino acid transport), member 2; Solute carrier family 30 (zinc transporter), member 6; Solute carrier family 39 (zinc transporter), member 10; Solute carrier family 43, member 1; Solute carrier family 9 (sodium/hydrogen exchanger), member 3 regulator 2; SON DNA binding protein; Sortilin-related VPS10 domain containing receptor 3; Sparc/osteonectin, cwcv and kazal-like domains proteoglycan (testican) 2; Spectrin repeat containing, nuclear envelope 1; Sperm associated antigen 9; Splicing factor 3a, subunit 2, 66 kDa; Splicing factor 3b, subunit 1, 155 kDa; Staphylococcal nuclease and tudor domain containing 1; Staufen, RNA binding protein, homolog 1; Suppression of tumorigenicity 7; Suppressor of variegation 4-20 homolog 1; Synapsin III; Syntaxin 3; Syntaxin 5; Tachykinin receptor 1; TAO kinase 3; TBC1 domain family, member 16; TBC1 domain family, member 19; Testis specific, 10; Tetraspanin 6; Tetratricopeptide repeat domain 23; Thioredoxin-like 2; THUMP domain containing 3; TIMELESS interacting protein; TOX high mobility group box family member 4; Trafficking protein, kinesin binding 1; Transcription factor 7-like 1 (T-cell specific, HMG-box); Transcription factor 7-like 2 (T-cell specific, HMG-box); Translocase of inner mitochondrial membrane 13 homolog; Translocated promoter region (to activated MET oncogene); Translocation associated membrane protein 2; Transmembrane 9 superfamily member 2; Transmembrane emp24 protein transport domain containing 8; Transmembrane emp24-like trafficking protein 10; Transmembrane protein 134; Transmembrane protein 18; Transmembrane protein 18; Transmembrane protein 29; Triadin; Tribbles homolog 1; Trinucleotide repeat containing 6C; Tripartite motif-containing 36; Tripartite motif-containing 61; TRNA methyltransferase 11 homolog; TruB pseudouridine (psi) synthase homolog 2; Tubby like protein 4; Tuftelin 1; Tumor necrosis factor receptor superfamily, member 11b (osteoprotegerin); Tumor necrosis factor receptor superfamily, member 25; Tumor necrosis factor, alpha-induced protein 8; Tyrosine kinase 2; Ubiquinol-cytochrome c reductase core protein I; Ubiquitin specific peptidase 47; Ubiquitin specific peptidase 5 (isopeptidase T); Ubiquitin specific peptidase 8; Ubiquitin-like 7 (bone marrow stromal cell-derived); UBX domain containing 6; UDP-glucose ceramide glucosyltransferase-like 2; UDP-N-acetyl-alpha-D-galactosamine:polypeptide N-acetylgalactosaminyltransferase 2 (GalNAc-T2); Unc-93 homolog Bl;UTP6, small subunit (SSU) processome component, homolog; Vacuolar protein sorting 8 homolog; V-akt murine thymoma viral oncogene homolog 1; V-ets erythroblastosis virus E26 oncogene homolog; Viral DNA polymerase-transactivated protein 6; WD repeat domain 33; WD repeat domain 90; Wingless-type MMTV integration site family, member 2B; WW and C2 domain containing 1; Yipl domain family, member 3; YTH domain family, member 3; Zinc finger and BTB domain containing 10; Zinc finger and BTB domain containing 20; Zinc finger and SCAN domain containing 18; Zinc finger homeodbmain 4; Zinc finger protein 14 homolog; Zinc finger protein 335; Zinc finger protein 394; Zinc finger protein 407; Zinc finger protein 608; Zinc finger protein 667; Zinc finger protein 692; Zinc finger protein 718; Zinc finger protein 721; Zinc finger, CCHC domain containing 9; Zinc finger, matrin type 1; Zinc finger, MYND domain containing 11; Zinc finger, ZZ-type containing 3; Zinc fingers and homeoboxes 2; and Zwilch, kinetochore associated, homolog.

In one embodiment, the library comprises at least one transcript from at least one gene selected from the group consisting of Replication factor C (activator 1) 3; Tripartite motif-containing 61; Citrate lyase beta like; Ankyrin repeat domain 15; UDP-glucose ceramide glucosyltransferase-like 2; Hypothetical protein FLJ12949; Chromosome 22 open reading frame 13; Phosphatidylinositol glycan anchor biosynthesis, class O; Solute carrier family 43, member 1; Rabaptin, RAB GTPase binding effector protein 1; Zinc finger protein 14 homolog; Hypothetical gene supported by AK128346; Adenylate cyclase 3; Phosphatidylinositol transfer protein, beta; Zinc finger protein 667; Gremlin 1, cysteine knot superfamily, homolog; Ankyrin 3, node of Ranvier (ankyrin G) and Maltase-glucoamylase (alpha-glucosidase).

In one embodiment, the library comprises at least one transcript from at least one gene selected from the group consisting of Replication factor C (activator 1) 3; Ankyrin repeat domain 15; Hypothetical protein FLJ12949; Solute carrier family 43, member 1; Thioredoxin-like 2; Polymerase (RNA) II (DNA directed) polypeptide L; Syntaxin 5; Leucine rich repeat containing 16; Calcium channel, voltage-dependent, beta 4 subunit; [NM_001005522]; G protein-coupled receptor kinase interactor 2; Ankyrin 3, node of Ranvier (ankyrin G); Gremlin 1, cysteine knot superfamily, homolog; Zinc finger protein 667; Hypothetical gene supported by AK128346; Transmembrane 9 superfamily member 2; Potassium channel, subfamily K, member 1; Chromodomain helicase DNA binding protein 2; Microcephaly, primary autosomal recessive 1; Chromosome 21 open reading frame 34 and Dual specificity phosphatase 5.

In one embodiment, the library comprises at least one transcript from at least one gene selected from the group consisting of Replication factor C (activator 1) 3; Tripartite motif-containing 61; Citrate lyase beta like; Ankyrin repeat domain 15; Ankyrin 3, node of Ranvier (ankyrin G) and Maltase-glucoamylase (alpha-glucosidase).

In one embodiment, the library comprises at least one transcript from at least one gene selected from the group consisting of Replication factor C (activator 1) 3; Ankyrin repeat domain 15; Hypothetical protein FLJ12949; Solute carrier family 43, member 1; Thioredoxin-like 2; Polymerase (RNA) II (DNA directed) polypeptide L; Syntaxin 5; Leucine rich repeat containing 16; Calcium channel, voltage-dependent, beta 4 subunit; [NM_001005522]; G protein-coupled receptor kinase interactor 2; Ankyrin 3, node of Ranvier (ankyrin G); Gremlin 1, cysteine knot superfamily, homolog; Zinc finger protein 667; Hypothetical gene supported by AK128346; Transmembrane 9 superfamily member 2; Potassium channel, subfamily K, member 1; Chromodomain helicase DNA binding protein 2; Chromosome 9 open reading frame 94; Chromosome 21 open reading frame 34; and Dual specificity phosphatase 5.

In one embodiment, the library comprises at least one transcript from at least one gene selected from the group consisting of Citrate lyase beta like; Phosphodiesterase 4D, cAMP-specific; Ectodysplasin A receptor; DEP domain containing 6; Basonuclin 2; Chromosome 2 open reading frame 3; FLJ25476 protein; Staphylococcal nuclease and tudor domain containing 1; Hermansky-Pudlak syndrome 5 and Chromosome 12 open reading frame 30.

In one embodiment, the library comprises at least one transcript from at least one gene selected from the group consisting of Replication factor C (activator 1) 3; Tripartite motif-containing 61; Citrate lyase beta like; Adaptor-related protein complex 1, gamma 2 subunit; Kallikrein-related peptidase 2; Phosphodiesterase 4D, cAMP-specific; Cytochrome P450, family 4, subfamily F, polypeptide 11; Ectodysplasin A receptor Phospholipase C, beta 1; KIAA1244; Paraoxonase 2; Arachidonate 12-lipoxygenase, 12R type; Cut-like 2; Chemokine (C-X-C motif) ligand 12; Rho guanine nucleotide exchange factor (GEF) 5; Olfactory receptor, family 2, subfamily A, member 4; Chromosome 19 open reading frame 42; Hypothetical gene supported by AK128346; Phosphoglucomutase 5; Hyaluronan binding protein 4; NECAP endocytosis associated 2

Myeloid/lymphoid or mixed-lineage leukemia; translocated to, 4; Signal transducer and activator of transcription 1; Chromosome 2 open reading frame 3; FLJ25476 protein; Staphylococcal nuclease and tudor domain containing 1; Transmembrane protein 18; Hermansky-Pudlak syndrome 5; Chromosome 12 open reading frame 30; Splicing factor 3b, subunit 1; Cofilin 2; Heparan sulfate 6-0-Sulfotransferase 3; Enabled homolog; Mannosyl (alpha-1,6-)-glycoprotein beta-1,6-N-acetyl-glucosaminyltransferase; Solute carrier family 24 (sodium/potassium/calcium exchanger), member 3; Inositol 1,4,5-triphosphate receptor, type 1; CAP-GLY domain containing linker protein; Transglutaminase 4; MOCO sulphurase C-terminal domain containing 2; 4-hydroxyphenylpyruvate dioxygenase-like; and R3H domain containing 1.

The invention also contemplates that alternative libraries may be designed that include transcripts of one or more of the genes in Table 3, together with additional gene transcripts that have previously been shown to be associated with prostate cancer systemic progression. As is known in the art, the publication and sequence databases can be mined using a variety of search strategies to identify appropriate additional candidates for inclusion in the library. For example, currently available scientific and medical publication databases such as Medline, Current Contents, OMIM (online Mendelian inheritance in man), various Biological and Chemical Abstracts, Journal indexes, and the like can be searched using term or key-word searches, or by author, title, or other relevant search parameters. Many such databases are publicly available, and strategies and procedures for identifying publications and their contents, for example, genes, other nucleotide sequences, descriptions, indications, expression pattern, etc, are well known to those skilled in the art. Numerous databases are available through the internet for free or by subscription, see, for example, the National Center Biotechnology Information (NCBI), Infotrieve, Thomson ISI, and Science Magazine (published by the AAAS) websites. Additional or alternative publication or citation databases are also available that provide identical or similar types of information, any of which can be employed in the context of the invention. These databases can be searched for publications describing altered gene expression between recurrent and non-recurrent prostate cancer. Additional potential candidate genes may be identified by searching the above described databases for differentially expressed proteins and by identifying the nucleotide sequence encoding the differentially expressed proteins. A list of genes whose altered expression is between patients with recurrent disease and non-recurrent prostate cancer is presented in Table 6.

Prostate Cancer Prognostic Sets

A Prostate Prognostic Set comprises one or more target sequences identified within the gene transcripts in the prostate prognostic library, or a subset of these gene transcripts. The target sequences may be within the coding and/or non-coding regions of the gene transcripts. The set can comprise one or a plurality of target sequences from each gene transcript in the library, or subset thereof. The relative and/or normalized level of these target sequences in a sample is indicative of the level of expression of the particular gene transcript and thus of prostate cancer recurrence risk. For example, the relative and/or normalized expression level of one or more of the target sequences may be indicative of an recurrent form of prostate cancer and therefore prognostic for prostate cancer systemic progression while the relative and/or normalized expression level of one or more other target sequences may be indicative of a non-recurrent form of prostate cancer and therefore prognostic for a NED clinical outcome.

Accordingly, one embodiment of the present invention provides for a library or catalog of candidate target sequences derived from the transcripts (both coding and non-coding regions) of at least one gene suitable for classifying prostate cancer recurrence risk. In a further embodiment, the present invention provides for a library or catalog of candidate target sequences derived from the non-coding regions of transcripts of at least one gene suitable for classifying prostate cancer recurrence risk. In still a further embodiment, the library or catalog of candidate target sequences comprises target sequences derived from the transcripts of one or more of the genes set forth in Table 3 and/or Table 6. The library or catalog in affect provides a resource list of transcripts from which target sequences appropriate for inclusion in a Prostate Cancer Prognostic set can be derived. In one embodiment, an individual Prostate Cancer Prognostic set may comprise target sequences derived from the transcripts of one or more genes exhibiting a positive correlation with recurrent prostate cancer. In one embodiment, an individual Prostate Cancer Prognostic Set may comprise target sequences derived from the transcripts of one or more genes exhibiting a negative correlation with recurrent prostate cancer. In one embodiment, an individual Prostate Cancer Prognostic Set may comprise target sequences derived from the transcripts of two or more genes, wherein at least one gene has a transcript that exhibits a positive correlation with recurrent prostate cancer and at least one gene has a transcript that exhibits negative correlation with recurrent prostate cancer.

In one embodiment, the Prostate Cancer Prognostic Set comprises target sequences derived from the transcripts of at least one gene. In one embodiment, the Prostate Cancer Prognostic Set comprises target sequences derived from the transcripts of at least 5 genes. In another embodiment, the Prostate Cancer Prognostic set comprises target sequences derived from the transcripts of at least 10 genes. In a further embodiment, the Prostate Cancer Prognostic set comprises target sequences derived from the transcripts of at least 15 genes. In other embodiments, the Prostate Cancer Prognostic set comprises target sequences derived from the transcripts of at least 20, at least 25, at least 30, at least 35, at least 40, at least 45, at least 50, at least 55, at least 60 and at least 65 genes.

Following the identification of candidate gene transcripts, appropriate target sequences can be identified by screening for target sequences that have been annotated to be associated with each specific gene locus from a number of annotation sources including GenBank, RefSeq, Ensembl, dbEST, GENSCAN, TWINSCAN, Exoniphy, Vega, microRNAs registry and others (see Affymetrix Exon Array design note).

As part of the target sequence selection process, target sequences can be further evaluated for potential cross-hybridization against other putative transcribed sequences in the design (but not the entire genome) to identify only those target sequences that are predicted to uniquely hybridize to a single target.

Optionally, the set of target sequences that are predicted to uniquely hybridize to a single target can be further filtered using a variety of criteria including, for example, sequence length, for their mean expression levels across a wide selection of human tissues, as being representative of transcripts expressed either as novel alternative (i.e., non-consensus) exons, alternative retained introns, novel exons 5' or 3' of the gene's transcriptional start site or representing transcripts expressed in a manner antisense to the gene, amongst others.

In one embodiment, the Prostate Classification Set comprises target sequences derived from 382,253 base pair 3' of Replication factor C (activator 1) 3, 38 kDa; 58,123 base pair 3' of Tripartite motif-containing 61; in intron #3 of Citrate lyase beta like; in intron #2 of Ankyrin repeat domain 15; in exon #1 of UDP-glucose ceramide glucosyltransferase-like 2; in exon of #19 of Hypothetical protein FLJ12949; in intron #4 of Chromosome 22 open reading frame 13; in exon #2 of phatidylinositol glycan anchor biosynthesis, class 0; in exon #15 of Solute carrier family 43, member 1; in exon #1 of Rabaptin, RAB GTPase binding effector protein 1; in intron #38 of Maltase-glucoamylase (alpha-glucosidase); in intron #23 of Ankyrin 3, node of Ranvier (ankyrin G); 71,333 base pair 3' of Gremlin 1, cysteine knot superfamily, homolog; 1,561 base pair of 3' Zinc finger protein 667; in exon #4 of Phosphatidylinositol transfer protein, beta; in intron #18 of Adenylate cyclase 3; and in exon #2 of Hypothetical gene supported by AK128346.

In one embodiment, the Prostate Classification Set comprises target sequences derived from 382,253 base pair 3' of Replication factor C (activator 1) 3; in intron #2 of Ankyrin repeat domain 15; in exon #19 of Hypothetical protein FLJ12949; in exon #15 of Solute carrier family 43, member 1; 313,721 base pair 3' of Thioredoxin-like 2; in exon #2 of Polymerase (RNA) II (DNA directed) polypeptide L, 7.6kDa; in intron #10 of Syntaxin 5; 141,389 base pair 5' of Leucine rich repeat containing 16; in intron #2 of Calcium channel, voltage-dependent, beta 4 subunit; 5,474 base pair 5' of [NM_001005522]; in intron #14 of G protein-coupled receptor kinase interactor 2; in intron #23 of Ankyrin 3, node of Ranvier (ankyrin G); 71,333 base pair 3' of Gremlin 1, cysteine knot superfamily, homolog; 1,561 base pair of 3' of Zinc finger protein 667; in exon #2 of Hypothetical gene supported by AK128346; in intron #11 of Transmembrane 9 superfamily member 2; in intron #1 of Potassium channel, subfamily K, member 1; in intron #2 of Chromodomain helicase DNA binding protein 2; 22,184 base pair 5' of Microcephaly, primary autosomal recessive 1; in intron #4 of Chromosome 21 open reading frame 34; and in intron #2 of Dual specificity phosphatase 5.

In one embodiment, the Prostate Classification Set comprises target sequences derived from 382,253 base pair 3' of Replication factor C (activator 1) 3, 38 kDa; 58,123 base pair 3' of Tripartite motif-containing 61; in intron #3 of Citrate lyase beta like; in intron #2 of Ankyrin repeat domain 15; in intron #38 of Maltase-glucoamylase (alpha-glucosidase); and in intron #23 of Ankyrin 3, node of Ranvier (ankyrin G).

In one embodiment, the Prostate Classification Set comprises target sequences derived from 382,253 base pair 3' of Replication factor C (activator 1) 3, 38 kDa; in intron #2 of Ankyrin repeat domain 15; in exon #19 of Hypothetical protein FLJ12949; in exon #15 of Solute carrier family 43, member 1; 313,721 base pair 3' of Thioredoxin-like 2; in exon #2 of Polymerase (RNA) II (DNA directed) polypeptide L, 7.6kDa; in intron #10 of Syntaxin 5; 141,389 base pair 5' of Leucine rich repeat containing 16; in intron #2 of Calcium channel, voltage-dependent, beta 4 subunit; 5,474 base pair 5' of [NM_001005522]; in intron #14 of G protein-coupled receptor kinase interactor 2; in intron #2 of Ankyrin 3, node of Ranvier (ankyrin G); 71,333 base pair of 3' Gremlin 1, cysteine knot superfamily; 1,561 base pair 3' of Zinc finger protein 667; in exon #2 of Hypothetical gene supported by AK128346; in intron #11 of Transmembrane 9 superfamily member 2; in intron #1 of Potassium channel, subfamily K, member 1; in intron #2 of Chromodomain helicase DNA binding protein 2; in exon #8 of Chromosome 9 open reading frame 94; in intron #4 of Chromosome 21 open reading frame 34; and
in intron #2 of Dual specificity phosphatase 5.

In one embodiment, the Prostate Classification Set comprises target sequences derived from in intron #3 of Citrate lyase beta like; 210,560 base pair 5' of Phosphodiesterase 4D; 189,722 base pair 5' of Ectodysplasin A receptor; 3,510 base pair 3' of DEP domain containing 6; in exon #6 of Basonuclin 2; in intron #1 of Chromosome 2 open reading frame 3; in intron #1 of FLJ25476 protein; in intron #10 of Staphylococcal nuclease and tudor domain containing 1; in exon #22 of Hermansky-Pudlak syndrome 5; and in exon #24 of Chromosome 12 open reading frame 30.

In one embodiment, the Prostate Classification Set comprises target sequences derived from 382,253 base pair 3' of Replication factor C (activator 1) 3, 38 kDa; 58,123 base pair 3' of Tripartite motif-containing 61; in intron #3 of Citrate lyase beta like; in intron #1 of Adaptor-related protein complex 1, gamma 2 subunit; in intron #2 of Kallikrein-related peptidase 2; 210,560 base pair 5' of Phosphodiesterase 4D; 3,508 base pair 3' of Cytochrome P450, family 4, subfamily F, polypeptide 11; 189,722 base pair 5' of Ectodysplasin A receptor; in intron #2 of Phospholipase C, beta 1; in intron #10 of KIAA1244; in intron #2 of Paraoxonase 2; 11,235 base pair 3' of Arachidonate 12-lipoxygenase, 12R type; in exon #22 of Cut-like 2; 143,098 base pair 5' of Chemokine (C-X-C motif) ligand 12; in intron #6 of Rho guanine nucleotide exchange factor (GEF) 5; 15,057 base pair 5' of Olfactory receptor, family 2, subfamily A, member 4; 6,025 base pair 3' of Chromosome 19 open reading frame 42; in exon #2 of Hypothetical gene supported by AK128346; in exon #11 of Phosphoglucomutase 5; in exon #9 of Hyaluronan binding protein 4; in exon #8 of NECAP endocytosis associated 2; in intron #20 of Myeloid/lymphoid or mixed-lineage leukemia; 1,558 base pair 3' of Signal transducer and activator of transcription; in intron #1 of Chromosome 2 open reading frame 3; in intron #1 of F1125476 protein; in intron #10 of Staphylococcal nuclease and tudor domain containing 1; 84,468 base pair 3' of Transmembrane protein 18; in exon #22 of Hermansky-Pudlak syndrome 5; in exon #24 of Chromosome 12 open reading frame 30; 95,745 base pair of 3' Splicing factor 3b, subunit 1; in exon #4 of Cofilin 2; in intron #1 of Heparan sulfate 6-O-sulfotransferase 3; in intron #1 of Enabled homolog ; in intron #2 of Mannosyl (alpha-1,6-)-glycoprotein beta-1,6-N-acetyl-glucosaminyl-transferase; in intron #8 of Solute carrier family 24, member 3; 32,382 base pair 3' of Inositol 1,4,5-triphosphate receptor, type 1; in intron #9 of CAP-GLY domain containing linker protein 1; in exon #14 of Transglutaminase 4; in intron #4 of MOCO sulphurase C-terminal domain containing 2; 21,555 base pair 5' of 4 hydroxyphenylpyruvate dioxygenase-like; and in exon #26 of R3H domain containing 1.

In one embodiment, the potential set of target sequences can be filtered for their expression levels using the multi-tissue expression data made publicly available by Affymetrix at (http://www.affymetrix.com/support/technical/sample_data/exon_array_data.affx) such that probes with, for example, elevated expression across numerous tissues (non-specific) or no expression in prostate tissue can be excluded.

Validation of Target Sequences

Following in silico selection of target sequences, each target sequence suitable for use in the Prostate Cancer Prognostic Set may be validated to confirm differential relative or normalized expression in recurrent prostate cancer or non-recurrent prostate cancer. Validation methods are known in the art and include hybridization techniques such as microarray analysis or Northern blotting using appropriate controls, and may include one or more additional steps, such as reverse transcription, transcription, PCR, RT-PCR and the like. The validation of the target sequences using these methods is well within the abilities of a worker skilled in the art.

Minimal Expression Signature

In one embodiment, individual Prostate Cancer Prognostic Sets provide for at least a determination of a minimal expression signature, capable of distinguishing recurrent from non-recurrent forms of prostate cancer. Means for determining the appropriate number of target sequences necessary to obtain a minimal expression signature are known in the art and include the Nearest Shrunken Centroids (NSC) method.

In this method (see US 20070031873), a standardized centroid is computed for each class. This is the average gene expression for each gene in each class divided by the within-class standard deviation for that gene. Nearest centroid classification takes the gene expression profile of a new sample, and compares it to each of these class centroids. The class whose centroid that it is closest to, in squared distance, is the predicted class for that new sample. Nearest shrunken centroid classification "shrinks" each of the class centroids toward the overall centroid for all classes by an amount called the threshold. This shrinkage consists of moving the centroid towards zero by threshold, setting it equal to zero if it hits zero. For example if threshold was 2.0, a centroid of 3.2 would be shrunk to 1.2, a centroid of −3.4 would be shrunk to −1.4, and a centroid of 1.2 would be shrunk to zero. After shrinking the centroids, the new sample is classified by the usual nearest centroid rule, but using the shrunken class centroids. This shrinkage can make the classifier more accurate by reducing the effect of noisy genes and provides an automatic gene selection. In particular, if a gene is shrunk to zero for all classes, then it is eliminated from the prediction rule. Alternatively, it may be set to zero for all classes except one, and it can be learned that the high or low expression for that gene characterizes that class. The user decides on the value to use for threshold. Typically one examines a number of different choices. To guide in this choice, PAM does K-fold cross-validation for a range of threshold values. The samples are divided up at random into K roughly equally sized parts. For each part in turn, the classifier is built on the other K-1 parts then tested on the remaining part. This is done for a range of threshold values, and the cross-validated misclassification error rate is reported for each threshold value. Typically, the user would choose the threshold value giving the minimum cross-validated misclassification error rate.

Alternatively, minimal expression signatures can be established through the use of optimization algorithms such as the mean variance algorithm widely used in establishing stock portfolios. This method is described in detail in US patent publication number 20030194734. Essentially, the method calls for the establishment of a set of inputs (stocks in financial applications, expression as measured by intensity here) that will optimize the return (e.g., signal that is generated) one receives for using it while minimizing the variability of the return. In other words, the method calls for the establishment of a set of inputs (e.g., expression as measured by intensity) that will optimize the signal while minimizing variability. Many commercial software programs are available to conduct such operations. "Wagner Associates Mean-Variance Optimization Application," referred to as "Wagner Software" throughout this specification, is preferred. This software uses functions from the "Wagner Associates Mean-Variance Optimization Library" to determine an efficient frontier and optimal portfolios in the Markowitz sense is preferred. Use of this type of software requires that microarray data be transformed so that it can be treated as an input in the way stock return and risk measurements are used when the software is used for its intended financial analysis purposes.

The process of selecting a minimal expression signature can also include the application of heuristic rules. Preferably, such rules are formulated based on biology and an understanding of the technology used to produce clinical results. More preferably, they are applied to output from the optimization method. For example, the mean variance method of portfolio selection can be applied to microarray data for a number of genes differentially expressed in subjects with cancer. Output from the method would be an optimized set of genes that could include some genes that are expressed in peripheral blood as well as in diseased tissue.

Other heuristic rules can be applied that are not necessarily related to the biology in question. For example, one can apply a rule that only a prescribed percentage of the portfolio can be represented by a particular gene or group of genes. Commercially available software such as the Wagner Software readily accommodates these types of heuristics. This can be useful, for example, when factors other than accuracy and precision (e.g., anticipated licensing fees) have an impact on the desirability of including one or more genes.

In one embodiment, the Prostate Cancer Prognostic Set for obtaining a minimal expression signature comprises at least one, two, three, four, five, six, eight, 10, 15, 20, 25 or more of target sequences shown to have a positive correlation with non-recurrent prostate disease, for example those depicted in SEQ ID NOs:1-913 or a subset thereof. In another embodiment, the Prostate Cancer Prognostic Set for obtaining a minimal expression signature comprises at least one, two, three, four, five, six, eight, 10, 15, 20, 25 or more of those target sequences shown to have a positive correlation with recurrent prostate cancer, for example those depicted in of SEQ ID NOs: 914-2114, or a subset therof. In yet another embodiment, the Prostate Cancer Prognostic Set for obtaining a minimal expression signature comprises at least one, two, three, four, five, six, eight, 10, 15, 20, 25 or more of target sequences shown to have a correlation with non-recurrent or recurrent prostate cancer, for example those depicted in SEQ ID NOs:1-2114 or a subset thereof.

In some embodiments, the Prostate Cancer Prognostic Set comprises target sequences for detecting expression products of SEQ IDs:1-2114. In some embodiments, the Prostate Cancer Prognostic Set comprises probes for detecting expression levels of sequences exhibiting positive and negative correlation with a disease status of interest are employed. For example, a combination target sequences useful in these methods were found to include those encoding RNAs corresponding to SEQ ID NOs: 1-913 (found at increased expression in prostate cancer samples from NED patients) and/or corresponding to SEQ ID NOs: 914-2114 (found at increased expression levels in prostate cancer samples from SYS patients), where intermediate levels of certain target sequences (Table 7) are observed in prostate cancer samples from PSA patients with biochemical recurrence, where the RNA expression levels are indicative of a disease state or outcome. Subgroups of these target sequences, as well as individual target sequences, have been found useful in such methods.

In some embodiments, an RNA signature corresponding to SEQ ID NOs: 1, 4, 6, 9, 14-16, 18-21 915-917, 920, 922, 928, 929, 931, 935 and 936 (the 21-RNA' signature) and/or SEQ ID NOs: 1-11, 914-920 (the '18-RNA' signature) and/or SEQ ID NOs: 1-4, 914, 915) (the '6-RNA' signature) and/or SEQ ID NOs: 1, 4, 6, 9, 14-16, 18-21, 915-917, 920, 922, 928, 929, 931, 935 and 936 (the '20-RNA' signature) and/or SEQ ID NOs 3, 36, 60, 63, 926, 971, 978, 999, 1014 and 1022 (the '10-RNA' signature) and/or SEQ ID NOs 1-3, 32, 33, 36, 46, 60, 63, 66, 69, 88, 100, 241, 265, 334, 437, 920, 925, 934, 945, 947, 954, 971, 978, 999, 1004, 1014, 1022, 1023, 1032, 1080, 1093, 1101, 1164, 1248, 1304, 1311, 1330, 1402 and 1425 (the '41-RNA' signature) are formulated into a linear combination of their respective expression values for each patient generating a patient outcome predictor ('POP') score and indicative of the disease status of the patient after prostatectomy.

Exemplary subsets and combinations of interest also include at least five, six, 10, 15, 18, 20, 23, 25, 27, 30, 35, 40, 45, 50, 55, 60, 70, 80, 90, 100, 125, 150, 175, 200, 225, 250, 275, 300, 350, 400, 450, 500, 750, 1000, 1200, 1400, 1600, 1800, 2000, or all 2114 target sequences in Table 4; at least five, six, 10, 15, 18, 20, 23, 25, 27, 30, 35, 40, 45, 50, 55, 60, 70, 80, 90, 100, 125, 150, 175, 200, 225, 250, 275, 300, 350, 400, 450, 500, or all 526 target sequences in Table 7; SEQ ID NOs:1, 4, 915, 6, 916, 9, 917, 920, 922, 14, 15, 16, 928, 929, 18, 19, 931, 20, 21, 935, 936, or combinations thereof; SEQ ID NOs:1, 2, 3, 4, 5, 6, 7, 8, 9, 10, 11, 914, 915, 916, 917, 918, 919, 920, or combinations thereof; SEQ ID NOs: 1, 4, 6, 9, 14-16, 18-21, 915-917, 920, 922, 928, 929, 931, 935, 936 or combinations thereof; SEQ ID NOs 3, 36, 60, 63, 926, 971, 978, 999, 1014, 1022 or combinations thereof; SEQ ID NOs 1-3, 32, 33, 36, 46, 60, 63, 66, 69, 88, 100, 241, 265, 334, 437, 920, 925, 934, 945, 947, 954, 971, 978, 999, 1004, 1014, 1022, 1023, 1032, 1080, 1093, 1101, 1164, 1248, 1304, 1311, 1330, 1402, 1425 or combinations thereof; at least one, two, three, four, five or six of SEQ ID NOs:1, 4, 6, 9, 14, 15, 16, 18, 19, 20, and 21 and at least one, two, three, four, five or six of SEQ ID NOs:915, 916, 917, 920, 922, 928, 929, 931, 935, and 936; and at least one, two, three, four, five or six of SEQ ID NOs:1, 2, 3, 4, 5, 6, 7, 8, 9, 10, and 11 at least one, two, three, four, five or six of at least one, two, three, four, five or six of SEQ ID NOs:914, 915, 916, 917, 918, 919, and 920 and at least one, two, three, four, five or six of SEQ ID NOs: 1, 4, 6, 9, 14-16, 18-21, 915-917, 920, 922, 928, 929, 931, 935, 936; and at least one, two, three, four, five or six of SEQ ID NOs 3, 36, 60, 63, 926, 971, 978, 999, 1014, 1022; and at least one, two, three, four, five or six of SEQ ID NOs 1-3, 32, 33, 36, 46, 60, 63, 66, 69, 88, 100, 241, 265, 334, 437, 920, 925, 934, 945, 947, 954, 971, 978, 999, 1004, 1014, 1022, 1023, 1032, 1080, 1093, 1101, 1164, 1248, 1304, 1311, 1330, 1402, 1425.

Exemplary subsets of interest include those described herein, including in the examples. Exemplary combinations of interest include those utilizing one or more of the sequences listed in Tables 5, 7, 8, 9 or 10. Of particular interest are those combinations utilizing at least one sequence exhibiting positive correlation with the trait of interest, as well as those combinations utilizing at least one sequence exhibiting negative correlation with the trait of interest. Also of interest are those combinations utilizing at least two, at least three, at least four, at least five or at least six of those sequences exhibiting such a positive correlation, in combination with at least two, at least three, at least four, at least five, or at least six of those sequences exhibiting such a negative correlation. Exemplary combinations include those utilizing at least one, two, three, four, five or six of the target sequences depicted in Tables 5 and 6.

In some embodiments, increased relative expression of one or more of SEQ IDs:1-913, decreased relative expression of one or more of SEQ ID NOs:914-2114 or a combination of any thereof is indicative/predictive of the patient exhibiting no evidence of disease for at least seven years or more after surgery. In some embodiments, increased relative expression of SEQ IDs:914-2114, decreased relative expression of one or more of SEQ ID NOs:1-913 or a combination of any thereof is indicative/predictive of the patient exhibiting systemic prostate cancer. Increased or decreased expression of target sequences represented in these sequence listings, or of the target sequences described in the examples, may be utilized in the methods of the invention.

The Prostate Cancer Prognostic Set can optionally include one or more target sequences specifically derived from the transcripts of one or more housekeeping genes and/or one or more internal control target sequences and/or one or more negative control target sequences. In one embodiment, these target sequences can, for example, be used to normalize expression data. Housekeeping genes from which target sequences for inclusion in a Prostate Cancer Prognostic Set can be derived from are known in the art and include those genes in which are expressed at a constant level in normal and prostate cancer tissue.

The target sequences described herein may be used alone or in combination with each other or with other known or later identified disease markers.

Prostate Cancer Prognostic Probes/Primers

The system of the present invention provides for combinations of polynucleotide probes that are capable of detecting the target sequences of the Prostate Cancer Prognostic Sets. Individual polynucleotide probes comprise a nucleotide sequence derived from the nucleotide sequence of the target sequences or complementary sequences thereof. The nucleotide sequence of the polynucleotide probe is designed such that it corresponds to, or is complementary to the target sequences. The polynucleotide probe can specifically hybridize under either stringent or lowered stringency hybridization conditions to a region of the target sequences, to the complement thereof, or to a nucleic acid sequence (such as a cDNA) derived therefrom.

The selection of the polynucleotide probe sequences and determination of their uniqueness may be carried out in silico using techniques known in the art, for example, based on a BLASTN search of the polynucleotide sequence in question against gene sequence databases, such as the Human Genome Sequence, UniGene, dbEST or the nonredundant database at NCBI. In one embodiment of the invention, the polynucleotide probe is complementary to a region of a target mRNA derived from a target sequence in the Prostate Cancer Prognostic Set. Computer programs can also be employed to select probe sequences that will not cross hybridize or will not hybridize non-specifically.

One skilled in the art will understand that the nucleotide sequence of the polynucleotide probe need not be identical to its target sequence in order to specifically hybridize thereto. The polynucleotide probes of the present invention, therefore, comprise a nucleotide sequence that is at least about 75% identical to a region of the target gene or mRNA. In another embodiment, the nucleotide sequence of the polynucleotide probe is at least about 90% identical a region of the target gene or mRNA. In a further embodiment, the nucleotide sequence of the polynucleotide probe is at least about 95% identical to a region of the target gene or mRNA. Methods of determining sequence identity are known in the art and can be determined, for example, by using 5 the BLASTN program of the University of Wisconsin Computer Group (GCG) software or provided on the NCBI website. The nucleotide sequence of the polynucleotide probes of the present invention may exhibit variability by differing (e.g. by nucleotide substitution, including transition or transversion) at one, two, three, four or more nucleotides from the sequence of the target gene.

Other criteria known in the art may be employed in the design of the polynucleotide probes of the present invention. For example, the probes can be designed to have <50% G content and/or between about 25% and about 70% G+C content. Strategies to optimize probe hybridization to the target nucleic acid sequence can also be included in the process of probe selection. Hybridization under particular pH, salt, and temperature conditions can be optimized by taking into account melting temperatures and by using empirical rules that correlate with desired hybridization behaviours. Computer models may be used for predicting the intensity and concentration-dependence of probe hybridization.

As is known in the art, in order to represent a unique sequence in the human genome, a probe should be at least 15 nucleotides in length. Accordingly, the polynucleotide probes of the present invention range in length from about 15 nucleotides to the full length of the target sequence or target mRNA. In one embodiment of the invention, the polynucleotide probes are at least about 15 nucleotides in length. In another embodiment, the polynucleotide probes are at least about 20 nucleotides in length. In a further embodiment, the polynucleotide probes are at least about 25 nucleotides in length. In another embodiment, the polynucleotide probes are between about 15 nucleotides and about 500 nucleotides in length. In other embodiments, the polynucleotide probes are between about 15 nucleotides and about 450 nucleotides, about 15 nucleotides and about 400 nucleotides, about 15 nucleotides and about 350 nucleotides, about 15 nucleotides and about 300 nucleotides in length.

The polynucleotide probes of a Prostate Cancer Prognostic Set can comprise RNA, DNA, RNA or DNA mimetics, or combinations thereof, and can be single-stranded or double-stranded. Thus the polynucleotide probes can be composed of naturally-occurring nucleobases, sugars and covalent internucleoside (backbone) linkages as well as polynucleotide probes having non-naturally-occurring portions which function similarly. Such modified or substituted polynucleotide probes may provide desirable properties such as, for example, enhanced affinity for a target gene and increased stability.

The system of the present invention further provides for primers and primer pairs capable of amplifying target sequences defined by the Prostate Cancer Prognostic Set, or fragments or subsequences or complements thereof. The nucleotide sequences of the Prostate Cancer Prognostic set may be provided in computer-readable media for in silico applications and as a basis for the design of appropriate primers for amplification of one or more target sequences of the Prostate Cancer Prognostic Set.

Primers based on the nucleotide sequences of target sequences can be designed for use in amplification of the target sequences. For use in amplification reactions such as PCR, a pair of primers will be used. The exact composition of the primer sequences is not critical to the invention, but for most applications the primers will hybridize to specific sequences of the Prostate Cancer Prognostic Set under stringent conditions, particularly under conditions of high stringency, as known in the art. The pairs of primers are usually chosen so as to generate an amplification product of at least about 50 nucleotides, more usually at least about 100 nucleotides. Algorithms for the selection of primer sequences are generally known, and are available in commercial software packages. These primers may be used in standard quantitative or qualitative PCR-based assays to assess transcript expression levels of RNAs defined by the Prostate Cancer Prognostic Set. Alternatively, these primers may be used in combination with probes, such as molecular beacons in amplifications using real-time PCR.

In one embodiment, the primers or primer pairs, when used in an amplification reaction, specifically amplify at least a portion of a nucleic acid depicted in one of SEQ ID NOs: 1-2114 (or subgroups thereof as set forth herein), an RNA form thereof, or a complement to either thereof.

As is known in the art, a nucleoside is a base-sugar combination and a nucleotide is a nucleoside that further includes a phosphate group covalently linked to the sugar portion of the nucleoside. In forming oligonucleotides, the phosphate groups covalently link adjacent nucleosides to one another to form a linear polymeric compound, with the normal linkage or backbone of RNA and DNA being a 3' to 5' phosphodiester linkage. Specific examples of polynucleotide probes or primers useful in this invention include oligonucleotides containing modified backbones or non-natural internucleoside linkages. As defined in this specification, oligonucleotides having modified backbones include both those that retain a phosphorus atom in the backbone and those that lack a phosphorus atom in the backbone. For the purposes of the present invention, and as sometimes referenced in the art, modified oligonucleotides that do not have a phosphorus atom in their internucleoside backbone can also be considered to be oligonucleotides.

Exemplary polynucleotide probes or primers having modified oligonucleotide backbones include, for example, those with one or more modified internucleotide linkages that are phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3' amino phosphoramidate and aminoalkylphosphoramidates, thionophosphoramidates, thionoalkyl-phosphonates, thionoallcylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

Exemplary modified oligonucleotide backbones that do not include a phosphorus atom are formed by short chain alkyl or cycloalkyl internucleoside linkages, mixed heteroatom and alkyl or cycloalkyl internucleoside linkages, or one or more short chain heteroatomic or heterocyclic internucleoside linkages. Such backbones include morpholino linkages (formed in part from the sugar portion of a nucleoside); siloxane backbones; sulfide, sulfoxide and sulphone backbones; formacetyl and thioformacetyl backbones; methylene formacetyl and thioformacetyl backbones; alkene containing backbones; sulphamate backbones; methyleneimino and methylenehydrazino backbones; sulphonate and sulfonamide backbones; amide backbones; and others having mixed N, 0, S and CH2 component parts.

The present invention also contemplates oligonucleotide mimetics in which both the sugar and the internucleoside linkage of the nucleotide units are replaced with novel groups. The base units are maintained for hybridization with an appropriate nucleic acid target compound. An example of such an oligonucleotide mimetic, which has been shown to have excellent hybridization properties, is a peptide nucleic acid (PNA) [Nielsen et al., *Science*, 254:1497-1500 (1991)]. In PNA compounds, the sugar-backbone of an oligonucleotide is replaced with an amide containing backbone, in particular an aminoethylglycine backbone. The nucleobases are retained and are bound directly or indirectly to aza-nitrogen atoms of the amide portion of the backbone.

The present invention also contemplates polynucleotide probes or primers comprising "locked nucleic acids" (LNAs), which are novel conformationally restricted oligonucleotide analogues containing a methylene bridge that connects the 2'-O of ribose with the 4'-C (see, Singh et al., *Chem. Commun.*, 1998, 4:455-456). LNA and LNA analogues display very high duplex thermal stabilities with complementary DNA and RNA, stability towards 3'-exonuclease degradation, and good solubility properties. Synthesis of the LNA analogues of adenine, cytosine, guanine, 5-methylcytosine, thymine and uracil, their oligomerization, and nucleic acid recognition properties have been described (see Koshkin et al., *Tetrahedron*, 1998, 54:3607-3630). Studies of mis-matched sequences show that LNA obey the Watson-Crick base pairing rules with generally improved selectivity compared to the corresponding unmodified reference strands.

LNAs form duplexes with complementary DNA or RNA or with complementary LNA, with high thermal affinities. The universality of LNA-mediated hybridization has been emphasized by the formation of exceedingly stable LNA: LNA duplexes (Koshkin et al., *J. Am. Chem. Soc.*, 1998, 120:13252-13253). LNA:LNA hybridization was shown to be the most thermally stable nucleic acid type duplex system, and the RNA-mimicking character of LNA was established at the duplex level. Introduction of three LNA monomers (T or A) resulted in significantly increased melting points toward DNA complements.

Synthesis of 2'-amino-LNA (Singh et al., J. Org. Chem., 1998, 63, 10035-10039) and 2'-methylamino-LNA has been described and thermal stability of their duplexes with complementary RNA and DNA strands reported. Preparation of phosphorothioate-LNA and 2'-thio-LNA have also been described (Kumar et al., Bioorg. Med. Chem. Lett., 1998, 8:2219 2222).

Modified polynucleotide probes or primers may also contain one or more substituted sugar moieties. For example, oligonucleotides may comprise sugars with one of the following substituents at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C1 to C10 alkyl or C2 to C10 alkenyl and alkynyl. Examples of such groups are: $O[(CH_2)_n O]_m CH_3$, $O(CH_2)_n OCH_3$, $O(CH_2)_n NH_2$, $O(CH_2)_n CH_3$, $O(CH_2)_n ONH_2$, and $O(CH_2)_n ON[(CH_2)_n CH_3)]_2$, where n and m are from 1 to about 10. Alternatively, the oligonucleotides may comprise one of the following substituents at the 2' position: $C_1$ to $C_{10}$ lower alkyl, substituted lower alkyl, alkaryl, aralkyl, O-alkaryl or O-aralkyl, SH, $SCH_3$, OCN, CI, Br, CN, $CF_3$, $OCF_3$, $SOCH_3$, $SO_2 CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Specific examples include 2'-methoxyethoxy (2'—O—$CH_2$ $CH_2$ $OCH_3$, also known as 2'—O—(2-methoxyethyl) or 2'-MOE) [Martin et al., *Helv. Chim. Acta*, 78:486-504(1995)], 2'-dimethylaminooxyethoxy ($O(CH_2)_2 ON(CH_3)_2$ group, also known as 2'-DMAOE), 2'-methoxy (2'—O—$CH_3$), 2'-aminopropoxy (2'—$OCH_2$ $CH_2$ $CH_2$ $NH_2$) and 2'-fluoro (2'3-F).

Similar modifications may also be made at other positions on the polynucleotide probes or primers, particularly the 3' position of the sugar on the 3' terminal nucleotide or in 2'-5' linked oligonucleotides and the 5' position of 5' terminal nucleotide. Polynucleotide probes or primers may also have sugar mimetics such as cyclobutyl moieties in place of the pentofuranosyl sugar.

Polynucleotide probes or primers may also include modifications or substitutions to the nucleobase. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5- hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further nucleobases include those disclosed in U.S. Pat. No. 3,687,808; The Concise Encyclopedia Of Polymer Science And Engineering, (1990) pp 858-859, Kroschwitz, J. I., ed. John Wiley & Sons; Englisch et al., *Angewandte Chemie, Int. Ed.,* 30:613 (1991); and Sanghvi, Y. S., (1993) *Antisense Research and Applications, pp* 289-302, Crooke, S. T. and Lebleu, B., ed., CRC Press. Certain of these nucleobases are particularly useful for increasing the binding affinity of the polynucleotide probes of the invention. These include 5-substituted pyrimidines, 6-azapyrimidines and N-2, N-6 and 0-6 substituted purines, including 2-aminopropyladenine, 5 propynyluracil and 5-propynylcytosine. 5-methylcytosine substitutions have been shown to increase nucleic acid duplex stability by 0.6-1.2° C. [Sanghvi, Y. S., (1993) *Antisense Research and Applications*, pp 276-278, Crooke, S. T. and Lebleu, B., ed., CRC Press, Boca Raton].

One skilled in the art will recognize that it is not necessary for all positions in a given polynucleotide probe or primer to be uniformly modified. The present invention, therefore, contemplates the incorporation of more than one of the aforementioned modifications into a single polynucleotide probe or even at a single nucleoside within the probe or primer.

One skilled in the art will also appreciate that the nucleotide sequence of the entire length of the polynucleotide probe or primer does not need to be derived from the target sequence. Thus, for example, the polynucleotide probe may comprise nucleotide sequences at the 5' and/or 3' termini that are not derived from the target sequences. Nucleotide sequences which are not derived from the nucleotide sequence of the target sequence may provide additional functionality to the polynucleotide probe. For example, they may provide a restriction enzyme recognition sequence or a "tag" that facilitates detection, isolation, purification or immobilisation onto a solid support. Alternatively, the additional nucleotides may provide a self-complementary sequence that allows the primer/probe to adopt a hairpin configuration. Such configurations are necessary for certain probes, for example, molecular beacon and Scorpion probes, which can be used . in solution hybridization techniques.

The polynucleotide probes or primers can incorporate moieties useful in detection, isolation, purification, or immobilisation, if desired. Such moieties are well-known in the art (see, for example, Ausubel et al., (1997 & updates) *Current Protocols in Molecular Biology*, Wiley & Sons, New York) and are chosen such that the ability of the probe to hybridize with its target sequence is not affected.

Examples of suitable moieties are detectable labels, such as radioisotopes, fluorophores, chemiluminophores, enzymes, colloidal particles, and fluorescent microparticles, as well as antigens, antibodies, haptens, avidin/streptavidin, biotin, haptens, enzyme cofactors/substrates, enzymes, and the like.

A label can optionally be attached to or incorporated into a probe or primer polynucleotide to allow detection and/or quantitation of a target polynucleotide representing the target sequence of interest. The target polynucleotide may be the expressed target sequence RNA itself, a cDNA copy thereof, or an amplification product derived therefrom, and may be the positive or negative strand, so long as it can be specifically detected in the assay being used. Similarly, an antibody may be labeled.

In certain multiplex formats, labels used for detecting different targets may be distinguishable. The label can be attached directly (e.g., via covalent linkage) or indirectly, e.g., via a bridging molecule or series of molecules (e.g., a molecule or complex that can bind to an assay component, or via members of a binding pair that can be incorporated into assay components, e.g. biotin-avidin or streptavidin). Many labels are commercially available in activated forms which can readily be used for such conjugation (for example through amine acylation), or labels may be attached through known or determinable conjugation schemes, many of which are known in the art.

Labels useful in the invention described herein include any substance which can be detected when bound to or incorporated into the biomoleculd of interest. Any effective detection method can be used, including optical, spectroscopic, electrical, piezoelectrical, magnetic, Raman scattering, surface plasmon resonance, colorimetric, calorimetric, etc. A label is typically selected from a chromophore, a lumiphore, a fluorophore, one member of a quenching system, a chromogen, a hapten, an antigen, a magnetic particle, a material exhibiting nonlinear optics, a semiconductor nanocrystal, a metal nanoparticle, an enzyme, an antibody or binding portion or equivalent thereof, an aptamer, and one member of a binding pair, and combinations thereof. Quenching schemes may be used, wherein a quencher and a fluorophore as members of a quenching pair may be used on a probe, such that a change in optical parameters occurs upon binding to the target introduce or quench the signal from the fluorophore. One example of such a system is a molecular beacon. Suitable quencher/fluorophore systems are known in the art. The label may be bound through a variety of intermediate linkages. For example, a polynucleotide may comprise a biotin-binding species, and an optically detectable label may be conjugated to biotin and then bound to the labeled polynucleotide. Similarly, a polynucleotide sensor may comprise an immunological species such as an antibody or fragment, and a secondary antibody containing an optically detectable label may be added.

Chromophores useful in the methods described herein include any substance which can absorb energy and emit light. For multiplexed assays, a plurality of different signaling chromophores can be used with detectably different emission spectra. The chromophore can be a lumophore or a fluorophore. Typical fluorophores include fluorescent dyes, semiconductor nanocrystals, lanthanide chelates, polynucleotide-specific dyes and green fluorescent protein.

Coding schemes may optionally be used, comprising encoded particles and/or encoded tags associated with different polynucleotides of the invention. A variety of different coding schemes are known in the art, including fluorophores, including SCNCs, deposited metals, and RF tags.

Polynucleotides from the described target sequences may be employed as probes for detecting target sequences expression, for ligation amplification schemes, or may be used as primers for amplification schemes of all or a portion of a target sequences. When amplified, either strand produced by amplification may be provided in purified and/or isolated form.

In one embodiment, polynucleotides of the invention include a nucleic acid depicted in(a) any one of SEQ ID NOs: 1-2114, or a subgroup thereof as set forth herein; (b) an RNA form of any one of the nucleic acids depicted in SEQ ID NOs: 1-2114, or a subgroup thereof as set forth herein; (c) a peptide nucleic acid form of any of the nucleic acids depicted in SEQ ID NOs: 1-2114, or a subgroup thereof as set forth herein; (d) a nucleic acid comprising at least 20 consecutive bases of any of (a-c); (e) a nucleic acid comprising at least 25 bases having at least 90% sequenced identity to any of (a-c); and (f) a complement to any of (a-e).

Complements may take any polymeric form capable of base pairing to the species recited in (a)-(e), including nucleic acid such as RNA or DNA, or may be a neutral polymer such as a peptide nucleic acid. Polynucleotides of the invention can be selected from the subsets of the recited nucleic acids described herein, as well as their complements.

In some embodiments, polynucleotides of the invention comprise at least 20 consecutive bases as depicted in SEQ ID NOs:1-2114, or a complement thereto. The polynucleotides may comprise at least 21, 22, 23, 24, 25, 27, 30, 32, 35 or more consecutive bases as depicted in SEQ ID NOs:1-2114, as applicable.

In some embodiments, the nucleic acid in (a) can be selected from those in Table 3, and from SEQ ID NOs:1, 4, 915, 6, 916, 9, 917, 920, 922, 14, 15, 16, 928, 929, 18, 19, 931, 20, 21, 935, and 936; or from SEQ 111 NOs:1, 2, 3, 4, 5, 6, 7, 8, 9, 10, 11, 914, 915, 916, 917, 918, 919, and 920; or from SEQ ID NOs: 1, 4, 6, 9, 14-16, 18-21, 915-917, 920, 922, 928, 929, 931, 935 and 936; or from SEQ ID NOs 3, 36, 60, 63, 926, 971, 978, 999, 1014 and 1022; or from SEQ ID NOs 1-3, 32, 33, 36, 46, 60, 63, 66, 69, 88, 100, 241, 265, 334, 437, 920, 925, 934, 945, 947, 954, 971, 978, 999, 1004, 1014, 1022, 1023, 1032, 1080, 1093, 1101, 1164, 1248, 1304, 1311, 1330, 1402 and 1425.

The polynucleotides may be provided in a variety of formats, including as solids, in solution, or in an array. The polynucleotides may optionally comprise one or more labels, which may be chemically and/or enzymatically incorporated into the polynucleotide.

In one embodiment, solutions comprising polynucleotide and a solvent are also provided. In some embodiments, the solvent may be water or may be predominantly aqueous. In some embodiments, the solution may comprise at least two, three, four, five, six, seven, eight, nine, ten, twelve, fifteen, seventeen, twenty or more different polynucleotides, including primers and primer pairs, of the invention. Additional substances may be included in the solution, alone or in combination, including one or more labels, additional solvents, buffers, biomolecules, polynucleotides, and one or more enzymes useful for performing methods described herein, including polymerases and ligases. The solution may further comprise a primer or primer pair capable of amplifying a polynucleotide of the invention present in the solution.

In some embodiments, one or more polynucleotides provided herein can be provided on a substrate. The substrate can comprise a wide range of material, either biological, nonbiological, organic, inorganic, or a combination of any of these. For example, the substrate may be a polymerized Langmuir Blodgett film, functionalized glass, Si, Ge, GaAs, GaP, $SiO_2$, $SiN_4$, modified silicon, or any one of a wide variety of gels or polymers such as (poly)tetrafluoroethylene, (poly)vinylidenedifluoride, polystyrene, cross-linked polystyrene, polyacrylic, polylactic acid, polyglycolic acid, poly(lactide coglycolide), polyanhydrides, poly(methyl methacrylate), poly(ethylene-co-vinyl acetate), polysiloxanes, polymeric silica, latexes, dextran polymers, epoxies, polycarbonates, or combinations thereof. Conducting polymers and photoconductive materials can be used.

Substrates can be planar crystalline substrates such as silica based substrates (e.g. glass, quartz, or the like), or crystalline substrates used in, e.g., the semiconductor and microprocessor industries, such as silicon, gallium arsenide, indium doped GaN and the like, and includes semiconductor nanocrystals.

The substrate can take the form of an array, a photodiode, an optoelectronic sensor such as an optoelectronic semiconductor chip or optoelectronic thin-film semiconductor, or a biochip. The location(s) of probe(s) on the substrate can be addressable; this can be done in highly dense formats, and the location(s) can be microaddressable or nanoaddressable.

Silica aerogels can also be used as substrates, and can be prepared by methods known in the art. Aerogel substrates may be used as free standing substrates or as a surface coating for another substrate material.

The substrate can take any form and typically is a plate, slide, bead, pellet, disk, particle, microparticle, nanoparticle, strand, precipitate, optionally porous gel, sheets, tube, sphere, container, capillary, pad, slice, film, chip, multiwell plate or dish, optical fiber, etc. The substrate can be any form that is rigid or semi-rigid. The substrate may contain raised or depressed regions on which an assay component is located. The surface of the substrate can be etched using known techniques to provide for desired surface features, for example trenches, v-grooves, mesa structures, or the like.

Surfaces on the substrate can be composed of the same material as the substrate or can be made from a different material, and can be coupled to the substrate by chemical or physical means. Such coupled surfaces may be composed of any of a wide variety of materials, for example, polymers, plastics, resins, polysaccharides, silica or silica-based materials, carbon, metals, inorganic glasses, membranes, or any of the above-listed substrate materials. The surface can be optically transparent and can have surface Si—OH functionalities, such as those found on silica surfaces.

The substrate and/or its optional surface can be chosen to provide appropriate characteristics for the synthetic and/or detection methods used. The substrate and/or surface can be transparent to allow the exposure of the substrate by light applied from multiple directions. The substrate and/or surface may be provided with reflective "mirror" structures to increase the recovery of light.

The substrate and/or its surface is generally resistant to, or is treated to resist, the conditions to which it is to be exposed in use, and can be optionally treated to remove any resistant material after exposure to such conditions.

The substrate or a region thereof may be encoded so that the identity of the sensor located in the substrate or region being queried may be determined. Any suitable coding scheme can be used, for example optical codes, RFID tags, magnetic codes, physical codes, fluorescent codes, and combinations of codes.

Preparation of Probes and Primers

The polynucleotide probes or primers of the present invention can be prepared by conventional techniques well-known to those skilled in the art. For example, the polynucleotide probes can be prepared using solid-phase synthesis using commercially available equipment. As is well-known in the art, modified oligonucleotides can also be readily prepared by similar methods. The polynucleotide probes can also be synthesized directly on a solid support according to methods standard in the art. This method of synthesizing polynucleotides is particularly useful when the polynucleotide probes are part of a nucleic acid array.

Polynucleotide probes or primers can be fabricated on or attached to the substrate by any suitable method, for example the methods described in U.S. Pat. No. 5,143,854, PCT Publ. No. WO 92/10092, U.S. patent application Ser. No. 07/624,120, filed Dec. 6, 1990 (now abandoned), Fodor et al., Science,•251: 767-777 (1991), and PCT Publ. No. WO 90/15070). Techniques for the synthesis of these arrays using mechanical synthesis strategies are described in, e.g., PCT Publication No. WO 93/09668 and U.S. Pat. No. 5,384,261. Still further techniques include bead based techniques such as those described in PCT Appl. No. PCT/US93/04145 and pin based methods such as those described in U.S. Pat. No. 5,288,514. Additional flow channel or spotting methods applicable to attachment of sensor polynucleotides to a substrate are described in U.S. patent application Ser. No. 07/980,523, filed Nov. 20, 1992, and U.S. Pat. No. 5,384,261.

Alternatively, the polynucleotide probes of the present invention can be prepared by enzymatic digestion of the naturally occurring target gene, or mRNA or cDNA derived therefrom, by methods known in the art.

PROSTATE CANCER PROGNOSTIC METHODS

The present invention further provides methods for characterizing prostate cancer sample for recurrence risk. The methods use the Prostate Cancer Prognostic Sets, probes and primers described herein to provide expression signatures or profiles from a test sample derived from a subject having or suspected of having prostate cancer. In some embodiments, such methods involve contacting a test sample with Prostate Cancer Prognostic probes (either in solution or immobilized) under conditions that permit hybridization of the probe(s) to any target nucleic acid(s) present in the test sample and then detecting any probe: target duplexes formed as an indication of the presence of the target nucleic acid in the sample. Expression patterns thus determined are then compared to one or more reference profiles or signatures. Optionally, the expression pattern can be normalized. The methods use the Prostate Cancer Prognostic Sets, probes and primers described herein to provide expression signatures or profiles from a test sample derived from a subject to classify the prostate cancer as recurrent or non-recurrent.

In some embodiments, such methods involve the specific amplification of target sequences nucleic acid(s) present in the test sample using methods known in the art to generate an expression profile or signature which is then compared to a reference profile or signature.

In some embodiments, the invention further provides for prognosing patient outcome, predicting likelihood of recurrence after prostatectomy and/or for designating treatment modalities.

In one embodiment, the methods generate expression profiles or signatures detailing the expression of the 2114 target sequences having altered relative expression with different prostate cancer outcomes. In one embodiment, the methods generate expression profiles or signatures detailing the expression of the subsets of these target sequences having 526 or 18 target sequences as described in the examples.

In some embodiments, increased relative expression of one or more of SEQ IDs:1-913, decreased relative expression of one or more of SEQ ID NOs:914-2114 or a combination of any thereof is indicative of a non-recurrent form of prostate cancer and may be predictive a NED clinical outcome after surgery. In some embodiments, increased relative expression of SEQ IDs:914-2114, decreased relative expression of one or more of SEQ ID NOs:1-913 or a combination of any thereof is indicative of a recurrent form of prostate cancer and may be predictive of a SYS clinical outcome after surgery. Increased or decreased expression of target sequences represented in these sequence listings, or of the target sequences described in the examples, may be utilized in the methods of the invention.

In one embodiment, intermediate levels of expression of one or more target sequences depicted in Table 7 indicate a probability of future biochemical recurrence.

In some embodiments, the methods detect combinations of expression levels of sequences exhibiting positive and negative correlation with a disease status. In one embodiment, the methods detect a minimal expression signature.

Any method of detecting and/or quantitating the expression of the encoded target sequences can in principle be used in the invention. Such methods can include Northern blotting, array or microarray hybridization, by enzymatic cleavage of specific structures (e.g., an Invader® assay, Third Wave Technologies, e.g. as described in U.S. Pat. Nos. 5,846,717, 6,090,543; 6,001,567; 5,985,557; and 5,994,069) and amplification methods, e.g. RT-PCR, including in a TaqMan® assay (PE Biosystems, Foster City, Calif., e.g. as described in U.S. Pat. Nos. 5,962,233 and 5,538,848), and may be quantitative or semi-quantitative, and may vary depending on the origin, amount and condition of the available biological sample. Combinations of these methods may also be used. For example, nucleic acids may be amplified, labeled and subjected to microarray analysis. Single-molecule sequencing (e.g., Illumina, Helicos, PacBio, ABI SOLID), in situ hybridization, bead-array technologies (e.g., Luminex xMAP, Illumina BeadChips), branched DNA technology (e.g., Panomics, Genisphere).

The expressed target sequences can be directly detected and/or quantitated, or may be copied and/or amplified to allow detection of amplified copies of the expressed target sequences or its complement. In some embodiments, degraded and/or fragmented RNA can be usefully analyzed for expression levels of target sequences, for example RNA having an RNA integrity number of less than 8.

In some embodiments, quantitative RT-PCR assays are used to measure the expression level of target sequences depicted in SEQ IDs: 1-2114. In other embodiments, a GeneChip or microarray can be used to measure the expression of one or more of the target sequences.

Molecular assays measure the relative expression levels of the target sequences, which can be normalized to the expression levels of one or more control sequences, for example array control sequences and/or one or more housekeeping genes, for example GAPDFI. Increased (or decreased) relative expression of the target sequences as described herein, including any of SEQ ID NOs:1-2114, may thus be used alone or in any combination with each other in the methods described herein. In addition, negative control probes may be included.

Diagnostic Samples

Diagnostic samples for use with the systems and in the methods of the present invention comprise nucleic acids suitable for providing RNAs expression information. In principle, the biological sample from which the expressed RNA is obtained and analyzed for target sequence expression can be any material suspected of comprising prostate cancer tissue or cells. The diagnostic sample can be a biological sample used directly in a method of the invention.

Alternatively, the diagnostic sample can be a sample prepared from a biological sample.

In one embodiments, the sample or portion of the sample comprising or suspected of comprising prostate cancer tissue or cells can be any source of biological material, including cells, tissue or fluid, including bodily fluids. Non-limiting examples of the source of the sample include an aspirate, a needle biopsy, a cytology pellet, a bulk tissue preparation or a section thereof obtained for example by surgery or autopsy, lymph fluid, blood, plasma, serum, tumors, and organs.

The samples may be archival samples, having a known and documented medical outcome, or may be samples from current patients whose ultimate medical outcome is not yet known.

In some embodiments, the sample may be dissected prior to molecular analysis. The sample may be prepared via macrodis section of a bulk tumor specimen or portion thereof, or may be treated via macrodissection, forexample via Laser Capture Microdissection (LCM).

The sample may initially be provided in a variety of states, as fresh tissue, fresh frozen tissue, fine needle aspirates, and may be fixed or unfixed. Frequently, medical laboratories routinely prepare medical samples in a fixed state, which facilitates tissue storage. A variety of fixatives can be used to fix tissue to stabilize the morphology of cells, and may be used alone or in combination with other agents. Exemplary fixatives include crosslinking agents, alcohols, acetone, Bouin's solution, Zenker solution, Hely solution, osmic acid solution and Carnoy solution.

Crosslinking fixatives can comprise any agent suitable for forming two or more covalent bonds, for example an aldehyde. Sources of aldehydes typically used for fixation include formaldehyde, paraformaldehyde, glutaraldehyde or formalin. Preferably, the crosslinking agent comprises formaldehyde, which may be included in its native form or in the form of paraformaldehyde or formalin. One of skill in the art would appreciate that for samples in which crosslinking fixatives have been used special preparatory steps may be necessary including for example heating steps and proteinase-k digestion; see methods One or more alcohols may be used to fix tissue, alone or in combination with other fixatives. Exemplary alcohols used for fixation include methanol, ethanol and isopropanol.

Formalin fixation is frequently used in medical laboratories. Formalin comprises both an alcohol, typically methanol, and formaldehyde, both of which can act to fix a biological sample.

Whether fixed or unfixed, the biological sample may optionally be embedded in an embedding medium. Exemplary embedding media used in histology including paraffin, Tissue-Tek® V.I.P.™, Paramat, Paramat Extra, Paraplast, Paraplast X-tra, Paraplast Plus, Peel Away Paraffin Embedding Wax, Polyester Wax, Carbowax Polyethylene Glycol, Polyfin™, Tissue Freezing Medium TFM™, Cryo-Gel™, and OCT Compound (Electron Microscopy Sciences, Hatfield, Pa.). Prior to molecular analysis, the embedding material may be removed via any suitable techniques, as known in the art. For example, where the sample is embedded in wax, the embedding material may be removed by extraction with organic solvent(s), for example xylenes. Kits are commercially available for removing embedding media from tissues. Samples or sections thereof may be subjected to further processing steps as needed, for example serial hydration or dehydration steps.

In some embodiments, the sample is a fixed, wax-embedded biological sample. Frequently, samples from medical laboratories are provided as fixed, wax-embedded samples, most commonly as formalin-fixed, paraffin embedded (FFPE) tissues.

Whatever the source of the biological sample, the target polynucleotide that is ultimately assayed can be prepared synthetically (in the case of control sequences), but typically is purified from the biological source and subjected to one or more preparative steps. The RNA may be purified to remove or diminish one or more undesired components from the biological sample or to concentrate it. Conversely, where the RNA is too concentrated for the particular assay, it may be diluted.

RNA Extraction

RNA can be extracted and purified from biological samples using any suitable technique. A number of techniques are known in the art, and several are commercially available (e.g., FormaPure™ nucleic acid extraction kit, Agencourt Biosciences, Beverly M A, High Pure FFPE RNA Micro Kit™, Roche Applied Science, Indianapolis, Ind.). RNA can be extracted from frozen tissue sections using TRIzol (Invitrogen, Carlsbad, Calif.) and purified using RNeasy Protect kit (Qiagen, Valencia, Calif.). RNA can be further purified using DNAse I treatment (Ambion, Austin, Tex.) to eliminate any contaminating DNA. RNA concentrations can be made using a Nanodrop ND-1000 spectrophotometer (Nanodrop Technologies, Rockland, Del.). RNA integrity can be evaluated by running electropherograms, and RNA integrity number (RIN, a correlative measure that indicates intactness of mRNA) can be determined using the RNA 6000 PicoAssay for the Bioanalyzer 2100 (Agilent Technologies, Santa Clara, Calif.).

Reverse Transcription For QRT-PCR Analysis

Reverse transcription can be performed using the Omniscript kit (Qiagen, Valencia, Calif.), Superscript III kit (Invitrogen, Carlsbad, Calif.), for RT-PCR. Target-specific priming can be performed in order to increase the sensitivity of detection of target sequences and generate target-specific cDNA.

Taqman® Gene Expression Analysis

25 TaqMan® RT-PCR can be performed using Applied Biosystems Prism (ABI) 7900 HT instruments in a 5 µl volume with target sequence-specific cDNA equivalent to 1 ng total RNA.

Primers and probes concentrations for TaqMan analysis are added to amplify fluorescent amplicons using PCR cycling conditions such as 95° C. for 10 minutes for one cycle, 95° C. for 20 seconds, and 60° C. for 45 seconds for 40 cycles. A reference sample can be assayed to ensure reagent and process stability. Negative controls (i.e., no template) should be assayed to monitor any exogenous nucleic acid contamination.

Amplification and Hybridization

Following sample collection and nucleic acid extraction, the nucleic acid portion of the sample comprising RNA that is or can be used to prepare the target polynucleotide(s) of interest can be subjected to one or more preparative reactions. These preparative reactions can include in vitro transcription (IVT), labeling, fragmentation, amplification and other reactions. mRNA can first be treated with reverse transcriptase and a primer to create cDNA prior to detection, quantitation and/or amplification; this can be done in vitro with purified mRNA or in situ, e.g., in cells or tissues affixed to a slide.

By "amplification" is meant any process of producing at least one copy of a nucleic acid, in this case an expressed RNA, and in many cases produces multiple copies. An amplification product can be RNA or DNA, and may include a complementary strand to the expressed target sequence. DNA amplification products can be produced initially through reverse translation and then optionally from further amplification reactions. The amplification product may include all or a portion of a target sequence, and may optionally be labeled. A variety of amplification methods are suitable for use, including polymerase-based methods and ligation-based methods. Exemplary amplification techniques include the polymerase chain reaction method (PCR), the ligase chain reaction (LCR), ribozyme-based methods, self sustained sequence replication (3SR), nucleic acid sequence-based amplification (NASBA), the use of Q Beta replicase, reverse transcription, nick translation, and the like.

Asymmetric amplification reactions may be used to preferentially amplify one strand representing the target sequence that is used for detection as the target polynucleotide. In some cases, the presence and/or amount of the amplification product itself may be used to determine the expression level of a given target sequence. In other instances, the amplification product may be used to hybridize to an array or other substrate comprising sensor polynucleotides which are used to detect and/or quantitate target sequence expression.

The first cycle of amplification in polymerase-based methods typically forms a primer extension product complementary to the template strand. If the template is single-stranded RNA, a polymerase with reverse transcriptase activity is used in the first amplification to reverse transcribe the RNA to DNA, and additional amplification cycles can be performed to copy the primer extension products. The primers for a PCR must, of course, be designed to hybridize to regions in their corresponding template that will produce an amplifiable segment; thus, each primer must hybridize so that its 3' nucleotide is paired to a nucleotide in its complementary template strand that is located 3' from the 3' nucleotide of the primer used to replicate that complementary template strand in the PCR.

The target polynucleotide can be amplified by contacting one or more strands of the target polynucleotide with a primer and a polymerase having suitable activity to extend the primer and copy the target polynucleotide to produce a full-length complementary polynucleotide or a smaller portion thereof. Any enzyme having a polymerase activity that can copy the target polynucleotide can be used, including DNA polymerases, RNA polymerases, reverse transcriptases, enzymes having more than one type of polymerase or enzyme activity. The enzyme can be thermolabile or thermostable. Mixtures of enzymes can also be used. Exemplary enzymes include: DNA polymerases such as DNA Polymerase I ("Pol I"), the Klenow fragment of Pol I, T4, T7, Sequenase® T7, Sequenase® Version 2.0 T7, Tub, Taq, Tth, Pfx, Pfu, Tsp, Tfl, 15 Tli and *Pyrococcus* sp G13-D DNA polymerases; RNA polymerases such as *E. coli*, SP6, T3 and T7 RNA polymerases; and reverse transcriptases such as AMV, M-MuLV, MMLV, RNAse MMLV (SuperScript®), SuperScript® II, ThermoScript®, HIV-1, and RAV2 reverse transcriptases. All of these enzymes are commercially available. Exemplary polymerases with multiple specificities include RAV2 and Tli (exo-) polymerases. Exemplary thermostable polymerases include Tub, Taq, Tth, Pfx, Pfu, Tsp, Tfl, Tli and Pyrococcus sp. GB-D DNA polymerases.

Suitable reaction conditions are chosen to permit amplification of the target polynucleotide, including pH, buffer, ionic strength, presence and concentration of one or more salts, presence and concentration of reactants and cofactors such as nucleotides and magnesium and/or other metal ions (e.g., manganese), optional cosolvents, temperature, thermal cycling profile for amplification schemes comprising a polymerase chain reaction, and may depend in part on the polymerase being used as well as the nature of the sample. Cosolvents include formamide (typically at from about 2 to about 10%), glycerol (typically at from about 5 to about 10%), and DMSO (typically at from about 0.9 to about 10%). Techniques may be used in the amplification scheme in order to minimize the production of false positives or artifacts produced during amplification. These include "touchdown" PCR, hot-start techniques, use of nested primers, or designing PCR primers so that they form stem-loop structures in the event of primer-dimer formation and thus are not amplified. Techniques to accelerate PCR can be used, for example centrifugal PCR, which allows for greater convection within the sample, and comprising infrared heating steps for rapid heating and cooling of the sample. One or more cycles of amplification can be performed. An excess of one primer can be used to produce an excess of one primer extension product during PCR; preferably, the primer extension product produced in excess is the amplification product to be detected. A plurality of different primers may be used to amplify different target polynucleotides or different regions of a particular target polynucleotide within the sample.

An amplification reaction can be performed under conditions which allow an optionally labeled sensor polynucleotide to hybridize to the amplification product during at least part of an amplification cycle. When the assay is performed in this manner, real-time detection of this hybridization event can take place by monitoring for light emission or fluorescence during amplification, as known in the art.

Where the amplification product is to be used for hybridization to an array or microarray, a number of suitable commercially available amplification products are available. These include amplification kits available from NuGEN, Inc. (San Carlos, Calif.), including the WT Ovation™ System, WT-Ovation™ System v2, WT-Ovation™ Pico System, WT-Ovation™ FFPE Exon Module, WT-Ovation™ FITE Exon Module RiboAmp and RiboAmp$^{Plus}$ RNA Amplification Kits (MDS Analytical Technologies (formerly Arcturus) (Mountain View, Calif.), Genisphere, Inc. (Hatfield, Pa.), including the RampUp Plus™ and SenseAmp™ RNA Amplification kits, alone or in combination. Amplified nucleic acids may be subjected to one or more purification reactions after amplification and labeling, for example using magnetic beads (e.g., RNAClean magnetic beads, Agencourt Biosciences).

Multiple RNA biomarkers can be analyzed using real-time quantitative multiplex RT-PCR platforms and other multiplexing technologies such as GenomeLab GeXP Genetic Analysis System (Beckman Coulter, Foster City, Calif.), SmartCycler® 9600 or GeneXpert(R) Systems (Cepheid, Sunnyvale, Calif.), ABI 7900 HT Fast Real Time PCR system (Applied Biosystems, Foster City, Calif.), LightCycler® 480 System (Roche Molecular Systems, Pleasanton, Calif.), xMAP 100 System (Luminex, Austin, Tex.) Solexa Genome Analysis System (Illumina, Hayward, Calif.), OpenArray Real Time qPCR (BioTrove, Woburn, Mass.) and BeadXpress System (Illumina, Hayward, Calif.).

Prostate Classification Arrays

The present invention contemplates that a Prostate Cancer Prognostic Set or probes derived therefrom may be provided in an array format. In the context of the present invention, an "array" is a spatially or logically organized collection of polynucleotide probes. Any array comprising sensor probes specific for two or more of SEQ ID NOs: 1-2114 or a product derived therefrom can be used. Desirably, an array will be specific for 5, 10, 15, 20, 25, 30, 50, 75, 100, 150, 200, 250, 300, 350, 400, 450, 500, 600, 700, 1000, 1200, 1400, 1600, 1800, 2000 or more of SEQ ID NOs: 1-2114. Expression of these sequences may be detected alone or in combination with other transcripts. In some embodiments, an array is used which comprises a wide range of sensor probes for prostate-specific expression products, along with appropriate control sequences. An array of interest is the Human Exon 1.0 ST Array (HuEx 1.0 ST, Affymetrix, Inc., Santa Clara, Calif.).

Typically the polynucleotide probes are attached to a solid substrate and are ordered so that the location (on the substrate) and the identity of each are known. The polynucleotide probes can be attached to one of a variety of solid substrates capable of withstanding the reagents and conditions necessary for use of the array. Examples include, but are not limited to, polymers, such as (poly)tetrafluoroethylene, (poly)vinylidenedifluoride, polystyrene, polycarbonate, polypropylene and polystyrene; ceramic; silicon; silicon dioxide; modified silicon; (fused) silica, quartz or glass; functionalized glass; paper, such as filter paper; diazotized cellulose; nitrocellulose filter; nylon membrane; and polyacrylamide gel pad. Substrates that are transparent to light are useful for arrays that will be used in an assay that involves optical detection.

Examples of array formats include membrane or filter arrays (for example, nitrocellulose, nylon arrays), plate arrays (for example, multiwell, such as a 24-, 96-, 256-, 384-, 864- or 1536-well, microtitre plate arrays), pin arrays, and bead arrays (for example, in a liquid "slurry"). Arrays on substrates such as glass or ceramic slides are often referred to as chip arrays or "chips." Such arrays are well known in the art. In one embodiment of the present invention, the Prostate Cancer Prognosticarray is a chip.

Data Analysis

Array data can be managed and analyzed using techniques known in the art. The Genetrix suite of tools can be used for microarray analysis (Epicenter Software, Pasadena, CA). Probe set modeling and data pre-processing can be derived using the Robust Multi-Array (RMA) algorithm or variant GC-RMA, Probe Logarithmic Intensity Error (PLIER) algorithm or variant iterPLIER. Variance or intensity filters can be applied to pre-process data using the RMA algorithm, for example by removing target sequences with a standard deviation of <10 or a mean intensity of <100 intensity units of a normalized data range, respectively.

In some embodiments, one or more pattern recognition methods can be used in analyzing the expression level of target sequences. The pattern recognition method can comprise a linear combination of expression levels, or a nonlinear combination of expression levels. In some embodiments, expression measurements for RNA transcripts or combinations of RNA transcript levels are formulated into linear or non-linear models or algorithms (i.e., an 'expression signature') and converted into a likelihood score. This likelihood score indicates the probability that a biological sample is from a patient who will exhibit no evidence of disease, who will exhibit systemic cancer, or who will exhibit biochemical recurrence. The likelihood score can be used to distinguish these disease states. The models and/or algorithms can be provided in machine readable format, and may be used to correlate expression levels or an expression profile with a disease state, and/or to designate a treatment modality for a patient or class of patients.

Thus, results of the expression level analysis can be used to correlate increased expression of RNAs corresponding to SEQ ID NOs: 1-2114, or subgroups thereof as described herein, with prostate cancer outcome, and to designate a treatment modality.

Factors known in the art for diagnosing and/or suggesting, selecting, designating, recommending or otherwise determining a course of treatment for a patient or class of patients suspected of having prostate cancer can be employed in combination with measurements of the target sequence expression. These techniques include cytology, histology, ultrasound analysis, MRI results, CT scan results, and measurements of PSA levels.

Certified tests for classifying prostate disease status and/or designating treatment modalities are also provided. A certified test comprises a means for characterizing the expression levels of one or more of the target sequences of interest, and a certification from a government regulatory agency endorsing use of the test for classifying the prostate disease status of a biological sample.

In some embodiments, the certified test may comprise reagents for amplification reactions used to detect and/or quantitate expression of the target sequences to be characterized in the test. An array of probe nucleic acids can be used, with or without prior target amplification, for use in measuring target sequence expression.

The test is submitted to an agency having authority to certify the test for use in distinguishing prostate disease status and/or outcome. Results of detection of expression levels of the target sequences used in the test and correlation with disease status and/or outcome are submitted to the agency. A certification authorizing the diagnostic and/or prognostic use of the test is obtained.

Also provided are portfolios of expression levels comprising a plurality of normalized expression levels of the target sequences described herein, including SEQ ID NOs: 1-2114. Such portfolios may be provided by performing the methods described herein to obtain expression levels from an individual patient or from a group of patients. The expression levels can be normalized by any method known in the art; exemplary normalization methods that can be used in various embodiments include Robust Multichip Average (RMA), probe logarithmic intensity error estimation (PLIER), non-linear fit (NLFIT) quantile-based and nonlinear normalization, and combinations thereof. Background correction can also be performed on the expression data; exemplary techniques useful for background correction include mode of intensities, normalized using median polish probe modeling and sketch-normalization.

In some embodiments, portfolios are established such that the combination of genes in the portfolio exhibit improved sensitivity and specificity relative to known methods. In considering a group of genes for inclusion in a portfolio, a small standard deviation in expression measurements correlates with greater specificity. Other measurements of variation such as correlation coefficients can also be used in this capacity. The invention also encompasses the above methods where the specificity is at least about 50% or at least about 60%. The invention also encompasses the above methods where the sensitivity is at least about 90%.

The gene expression profiles of each of the target sequences comprising the portfolio can fixed in a medium such as a computer readable medium. This can take a number of forms. For example, a table can be established into which the range of signals (e.g., intensity measurements) indicative of disease or outcome is input. Actual patient data can then be compared to the values in the table to determine the patient samples diagnosis or prognosis. In a more sophisticated embodiment, patterns of the expression signals (e.g., fluorescent intensity) are recorded digitally or graphically.

The expression profiles of the samples can be compared to a control portfolio. If the sample expression patterns are consistent with the expression pattern for a known disease or disease outcome, the expression patterns can be used to designate one or more treatment modalities. For patients with test scores consistent with systemic disease outcome after prostatectomy, additional treatment modalities such as adjuvant chemotherapy (e.g., docetaxel, mitoxantrone and prednisone), systemic radiation therapy (e.g., samarium or strontium) and/or anti-androgen therapy (e.g., surgical castration, finasteride, dutasteride) can be designated. Such patients would likely be treated immediately with anti-androgen therapy alone or in combination with radiation therapy in order to eliminate presumed micro-metastatic disease, which cannot be detected clinically but can be revealed by the target sequence expression signature. Such patients can also be more closely monitored for signs of disease progression. For patients with test scores consistent with PSA or NED, adjuvant therapy would not likely be recommended by their physicians in order to avoid treatment-related side effects such as metabolic syndrome (e.g., hypertension, diabetes and/or weight gain) or osteoporosis. Patients with samples consistent with NED could be designated for watchful waiting, or for no treatment. Patients with test scores that do not correlate with systemic disease but who have successive PSA increases could be designated for watchful waiting, increased monitoring, or lower dose or shorter duration anti-androgen therapy.

Target sequences can be grouped so that information obtained about the set of target sequences in the group can be used to make or assist in making a clinically relevant judgment such as a diagnosis, prognosis, or treatment choice.

A patient report is also provided comprising a representation of measured expression levels of a plurality of target sequences in a biological sample from the patient, wherein the representation comprises expression levels of target sequences corresponding to any one, two, three, four, five, six, eight, ten, twenty, thirty, fifty or more of the target sequences depicted in SEQ ID NOs: 1-2114, or of the subsets described herein, or of a combination thereof. In some embodiments, the representation of the measured expression level(s) may take the form of a linear or nonlinear combination of expression levels of the target sequences of interest. The patient report may be provided in a machine (e.g., a computer) readable format and/or in a hard (paper) copy. The report can also include standard measurements of expression levels of said plurality of target sequences from one or more sets of patients with known disease status and/or outcome. The report can be used to inform the patient and/or treating physician of the expression levels of the expressed target sequences, the likely medical diagnosis and/or implications, and optionally may recommend a treatment modality for the patient.

Also provided are representations of the gene expression profiles useful for treating, diagnosing, prognosticating, and otherwise assessing disease. In some embodiments, these profile representations are reduced to a medium that can be automatically read by a machine such as computer readable media (magnetic, optical, and the like). The articles can also include instructions for assessing the gene expression profiles in such media. For example, the articles may comprise a readable storage form having computer instructions for comparing gene expression profiles of the portfolios of genes described above. The articles may also have gene expression profiles digitally recorded therein so that they may be compared with gene expression data from patient samples. Alternatively, the profiles can be recorded in different representational format. A graphical recordation is one such format. Clustering algorithms can assist in the visualization of such data.

Kits

Kits for performing the desired method(s) are also provided, and comprise a container or housing for holding the components of the kit, one or more vessels containing one or more nucleic acid(s), and optionally one or more vessels containing one or more reagents. The reagents include those described in the composition of matter section above, and those reagents useful for performing the methods described, including amplification reagents, and may include one or more probes, primers or primer pairs, enzymes (including polymerases and ligases), intercalating dyes, labeled probes, and labels that can be incorporated into amplification products.

In some embodiments, the kit comprises primers or primer pairs specific for those subsets and combinations of target sequences described herein. At least two, three, four or five primers or pairs of primers suitable for selectively amplifying the same number of target sequence-specific polynucleotides can be provided in kit form. In some embodiments, the kit comprises from five to fifty primers or pairs of primers suitable for amplifying the same number of target sequence-representative polynucleotides of interest.

The primers or primer pairs of the kit, when used in an amplification reaction, specifically amplify at least a portion of a nucleic acid depicted in one of SEQ ID NOs: 1-2114 (or subgroups thereof as set forth herein), an RNA form thereof, or a complement to either thereof. The kit may include a plurality of such primers or primer pairs which can specifically amplify a corresponding plurality of different nucleic acids depicted in one of SEQ ID NOs: 1-2114 (or subgroups thereof as set forth herein), RNA forms thereof, or complements thereto. At least two, three, four or five primers or pairs of primers suitable for selectively amplifying the same number of target sequence-specific polynucleotides can be provided in kit form. In some embodiments, the kit comprises from five to fifty primers or pairs of primers suitable for amplifying the same number of target sequence-representative polynucleotides of interest.

The reagents may independently be in liquid or solid form. The reagents may be provided in mixtures. Control samples and/or nucleic acids may optionally be provided in the kit. Control samples may include tissue and/or nucleic acids obtained from or representative of prostate tumor samples from patients showing no evidence of disease, as well as tissue and/or nucleic acids obtained from or representative of prostate tumor samples from patients that develop systemic prostate cancer.

The nucleic acids may be provided in an array format, and thus an array or microarray may be included in the kit. The kit optionally may be certified by a government agency for use in prognosing the disease outcome of prostate cancer patients and/or for designating a treatment modality.

Instructions for using the kit to perform one or more methods of the invention can be provided with the container, and can be provided in any fixed medium. The instructions may be located inside or outside the container or housing, and/or may be printed on the interior or exterior of any surface thereof. A kit may be in multiplex form for concurrently detecting and/or quantitating one or more different target polynucleotides representing the expressed target sequences.

Devices

Devices useful for performing methods of the invention are also provided. The devices can comprise means for characterizing the expression level of a target sequence of the invention, for example components for performing one or more methods of nucleic acid extraction, amplification, and/or detection. Such components may include one or more of an amplification chamber (for example a thermal cycler), a plate reader, a spectrophotometer, capillary electrophoresis apparatus, a chip reader, and or robotic sample handling components. These components ultimately can obtain data that reflects the expression level of the target sequences used in the assay being employed.

The devices may include an excitation and/or a detection means. Any instrument that provides a wavelength that can excite a species of interest and is shorter than the emission wavelength(s) to be detected can be used for excitation. Commercially available devices can provide suitable excitation wavelengths as well as suitable detection components.

Exemplary excitation sources include a broadband UV light source such as a deuterium lamp with an appropriate filter, the output of a white light source such as a xenon lamp or a deuterium lamp after passing through a monochromator to extract out the desired wavelength(s), a continuous wave (cw) gas laser, a solid state diode laser, or any of the pulsed lasers. Emitted light can be detected through any suitable device or technique; many suitable approaches are known in the art. For example, a fluorimeter or spectrophotometer may be used to detect whether the test sample emits light of a wavelength characteristic of a label used in an assay.

The devices typically comprise a means for identifying a given sample, and of linking the results obtained to that sample. Such means can include manual labels, barcodes, and other indicators which can be linked to a sample vessel, and/or may optionally be included in the sample itself, for example where an encoded particle is added to the sample. The results may be linked to the sample, for example in a computer memory that contains a sample designation and a record of expression levels obtained from the sample. Linkage of the results to the sample can also include a linkage to a particular sample receptacle in the device, which is also linked to the sample identity.

The devices also comprise a means for correlating the expression levels of the target sequences being studied with a prognosis of disease outcome. Such means may comprise one or more of a variety of correlative techniques, including lookup tables, algorithms, multivariate models, and linear or nonlinear combinations of expression models or algorithms. The expression levels may be converted to one or more likelihood scores, reflecting a likelihood that the patient providing the sample will exhibit a particular disease outcome. The models and/or algorithms can be provided in machine readable format, and can optionally further designate a treatment modality for a patient or class of patients.

The device also comprises output means for outputting the disease status, prognosis and/or a treatment modality. Such output means can take any form which transmits the results to a patient and/or a healthcare provider, and may include a monitor, a printed format, or both. The device may use a computer system for performing one or more of the steps provided.

CITATIONS

Patents and Published Applications

1. US 2003/0224399 A1 patent application Methods for determining the prognosis for patients with a prostate neoplastic condition 2003-12-04
2. US 2007/0048738 A1 patent application Methods and compositions for diagnosis, staging and prognosis of prostate cancer 2007-03-01
3. US 2007/0099197 A1 patent application Methods of prognosis of prostate cancer 2007 May 03
4. US 2007/0259352 A1 patent application Prostate cancer-related nucleic acids 2007 Nov. 08
5. US 2008/0009001 A1 patent application Method for Identification of Neoplastic Transformation with Particular Reference to Prostate Cancer 2008 Jan. 10

Publications

1: Cooper C S, Campbell C, Jhavar S. Mechanisms of Disease: biomarkers and molecular targets from microarray gene expression studies in prostate cancer. Nat Clin Pract Urol. 2007 Dec;4(12):677-87. Review.

2: Reddy G K, Balk S P. Clinical utility of microarray-derived genetic signatures in predicting outcomes in prostate cancer. Clin Genitourin Cancer. 2006 Dec;5(3):187-9. Review.

3: Nelson P S. Predicting prostate cancer behavior using transcript profiles. J Urol. 2004 Nov;172(5 Pt 2):528-32; discussion S33. Review.

4: Bibikova M, Chudin E, Arsanjani A, Zhou L, Garcia E W, Modder J, Kostelec M, Barker D, Downs T, Fan J B, Wang-Rodriguez J. Expression signatures that correlated with Gleason score and relapse in prostate cancer. Genomics. 2007 Jun;89(6):666-72. Epub 2007 Apr 24.

5: Schlomm T, Erbersdobler A, Mirlacher M, Sauter G. Molecular staging of prostate cancer in the year 2007. World J Urol. 2007 Mar;25(1):19-30. Epub 2007 Mar 2. Review.

6: Mendiratta P, Febbo P G. Genomic signatures associated with the development, progression, and outcome of prostate cancer. Mol Diagn Then 2007;11(6):345-54.

7: Reddy G K, Balk S P. Clinical utility of microarray-derived genetic signatures in predicting outcomes in prostate cancer. Clin Genitourin Cancer. 2006 Dec;5(3):187-9. Review.

8: True L, Coleman I, Hawley S, Huang C Y, Gifford D, Coleman R, Beer T M, Gelmann E, Datta M, Mostaghel E, Knudsen B, Lange P, Vessella R, Lin D, Hood L, Nelson P S. A molecular correlate to the Gleason grading system for prostate adenocarcinoma. Proc Natl Acad Sci U S A. 2006 Jul. 18;103(29):10991-6. Epub 2006 Jul 7.

9: Stephenson A J, Smith A, Kattan M W, Satagopan J, Reuter V E, Scardino P T, Gerald W L. Integration of gene expression profiling and clinical variables to predict prostate carcinoma recurrence after radical prostatectomy. Cancer. 2005 Jul 15;104(2):290-8.

10: Bueno R, Loughlin K R, Powell M H, Gordon G J. A diagnostic test for prostate cancer from gene expression profiling data.J Urol. 2004 Feb;171(2 Pt 1):903-6.

11: Yu Y P, Landsittel D, Jing L, Nelson J, Ren B, Liu L, McDonald C, Thomas R, Dhir R, Finkelstein S, Michalopoulos G, Becich M, Luo J H. Gene expression alterations in prostate cancer predicting tumor aggression and preceding development of malignancy. J Clin Oncol. 2004 Jul 15;22(14):2790-9.

12: Feroze-Merzoug F, Schober M S, Chen Y Q. Molecular profiling in prostate cancer. Cancer Metastasis Rev. 2001;20(3-4):165-71. Review.

13: Nakagawa T, Kollmeyer T M, Morlan B W, Anderson S K, Bergstralh E J, Davis B J, Asmann Y W, Klee G G, Ballman K V, Jenkins R B. A tissue biomarker panel predicting systemic progression after PSA recurrence post-definitive prostate cancer therapy. PLoS ONE. 2008; 10 3(5):e2318.

14: Shariat S F, Karakiewicz P I, Roehrborn C G, Kattan M W. An updated catalog of prostate cancer predictive tools. Cancer 2008; 113(11): 3062-6.

EXAMPLES

To gain a better understanding of the invention described herein, the following examples are set forth. It will be understood that these examples are intended to describe illustrative embodiments of the invention and are not intended to limit the scope of the invention in any way. Efforts have been made to ensure accuracy with respect to numbers used (e.g., amounts, temperature, etc.) but some experimental error and deviation should be accounted for. Unless otherwise indicated, parts are parts by weight, temperature is degree centigrade and pressure is at or near atmospheric, and all materials are commercially available.

Example 1

Identification of Target Sequences Differentially Expressed in Prostate Disease States Tissue Samples. Formalin-fixed paraffin embedded (FFPE) samples of human prostate adenocarcinoma prostatectomies were collected from patients at the Mayo Clinic Comprehensive Cancer Center according to an institutional review board-approved protocol and stored in the Department of Pathology for up to 20 years. For each patient sample four 4 micron sections were cut from formalin-fixed paraffin embedded blocks. Pathological review of FFPE tissue sections was used to guide macrodissection of tumor and surrounding normal tissue. Patients were classified into one of three clinical disease states; no evidence of disease (NED, n=10) for those patients with no biochemical or other clinical signs of disease progression (at least 10 years follow-up); prostate-specific antigen biochemical recurrence (PSA, n=10) for those patients with two successive increases in PSA measurements above an established cut-point of >4 ng/mL ('rising PSA'); and systemic disease (SYS, n=10) for those patients that had 'rising PSA' and developed metastases or clinically detectable disease progression within five years after initial prostatectomy. Clinical disease was confirmed using bone or CT scans for prostate cancer metastases.

RNA Extraction. RNA was extracted and purified from FFPE tissue sections using a modified protocol for the commercially available High Pure FFPE RNA Micro nucleic acid extraction kit (Roche Applied Sciences, Indianapolis, Ind.). RNA concentrations were calculated using a Nanodrop ND-1000 spectrophotometer (Nanodrop Technologies, Rockland, Del).

RNA Amplification and GeneChip Hybridization. Purified RNA was subjected to whole-transcriptome amplification using the WT-Ovation FFPE system including the WT-Ovation Exon and FL-Ovation Biotin V2 labeling modules, with the following modifications. Fifty (50) nanograms of RNA extracted from FFPE sections was used to generate amplified Ribo-SPIA product. For the WT-Ovation Exon sense-target strand conversion kit 4 ug of Ribo-SPIA product were used. All clean-up steps were performed with RNAC lean magnetic beads (Agencourt Biosciences). Between 2.5 and 5 micrograms of WT-Ovation Exon product were used to fragment and label using the FL-Ovation Biotin V2 labeling module and labeled product was hybridized to Affymetrix Human Exon 1.0 ST GeneChips following manufacturer's recommendations (Affymetrix, Santa Clara, Calif.). Of the 30 samples processed, 22 had sufficient amplified material (i.e., >2.5 ug of WT-Ovation Exon product) for GeneChip hybridization.

Microarray Analysis. All data management and analysis was conducted using the Genetrix suite of tools for microarray analysis (Epicenter Software, Pasadena, Calif.). Probe set modeling and data pre-processing were derived using the Robust Multi-Array (RMA) algorithm. The mode of intensity values was used for background correction and RMA-sketch was used for normalization and probe modeling used a median polish routine. A variance filter was applied to data pre-processed using the RMA algorithm, by removing target sequences with a mean intensity of <10 intensity units of a normalized data range. Target sequences typically comprise four individual probes that interrogate the expression of RNA transcripts or portions thereof. Target sequence annotations and the sequences (RNAs) that they interrogate were downloaded from the Affymetrix website (www.netaffx-.com). Supervised analysis of differentially expressed RNA transcripts was determined based on the fold change in the average expression (at least 2 fold change) and the associated t-test, with a p-value cut-off of p<0.001 between different prostate cancer patient disease states. Linear regression was also used to screen differentially expressed transcripts that displayed an expression pattern of NED>PSA>SYS or SYS>PSA>NED and genes were selected with a p-value cut-off of p<0.01 for two-way hierarchical clustering using Pearson's correlation distance metric with complete-linkage cluster distances.

Archived FFPE blocks of tumors were selected from 30 patients that had undergone a prostatectomy at the Mayo Clinic Comprehensive Cancer Center between the years 1987-1997, providing for at least 10 years follow-up on each patient. Twenty-two patient samples had RNA of sufficient quantity and quality for RNA amplification and subsequent GeneChip hybridization. Three clinical categories of patients were evaluated; patients alive with no evidence of disease ('NED', n=6), patients with rising PSA or biochemical recurrence (defined as two successive increases in PSA measurements) ('PSA', n=7) and patients with rising PSA and clinical evidence of systemic or recurrent disease (e.g., determined by bone scan, CT) ('SYS', n=9) after prostatectomy. No statistically significant differences between these three clinical groups were apparent when considering pathological factors such as Gleason score or tumor stage (Table 1). As samples from older archived FFPE blocks are typically more degraded and fragmented than younger blocks, the distribution of block ages was similar in the three clinical groups so as not to skew or bias the results due to a block age effect. Fifty nanograms of RNA extracted from FFPE sections was amplified and hybridized to whole-transcriptome microarrays, interrogating >1.4 million probe target sequences measuring RNA levels for RefSeq, dbEST and predicted transcripts (collectively, 'RNAs').

Table 3 displays the number of target sequences identified in two-way comparisons between different clinical states using the appropriate t-tests and a p-value cut-off of p<0.001. At total of 2,114 target sequences (Table 3) were identified as differentially expressed in these comparisons and a principle components analysis demonstrates that these target sequences discriminate the distinct clinical states into three clusters (FIG. 1A).

Figure 1B:
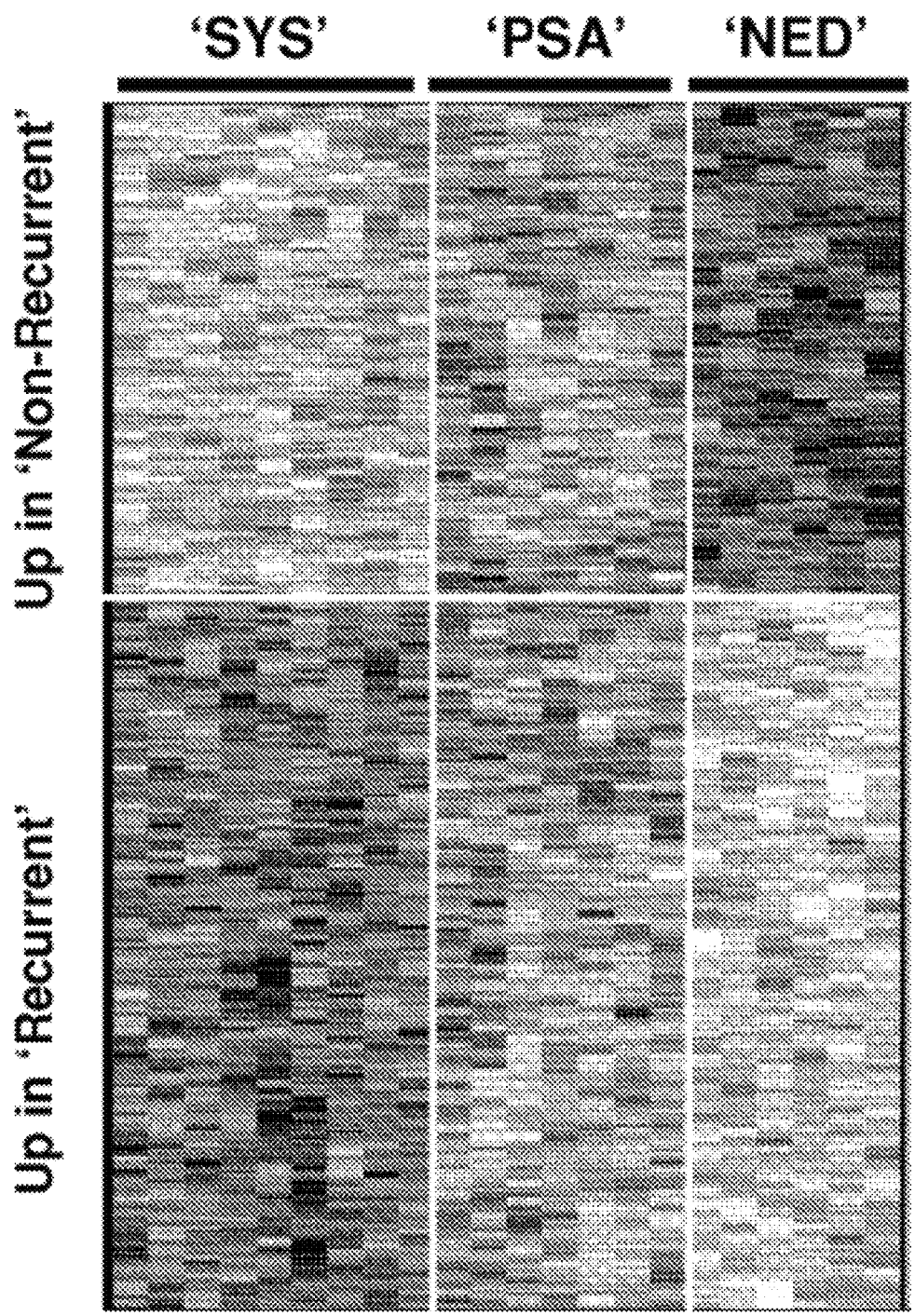
Figure 1C:
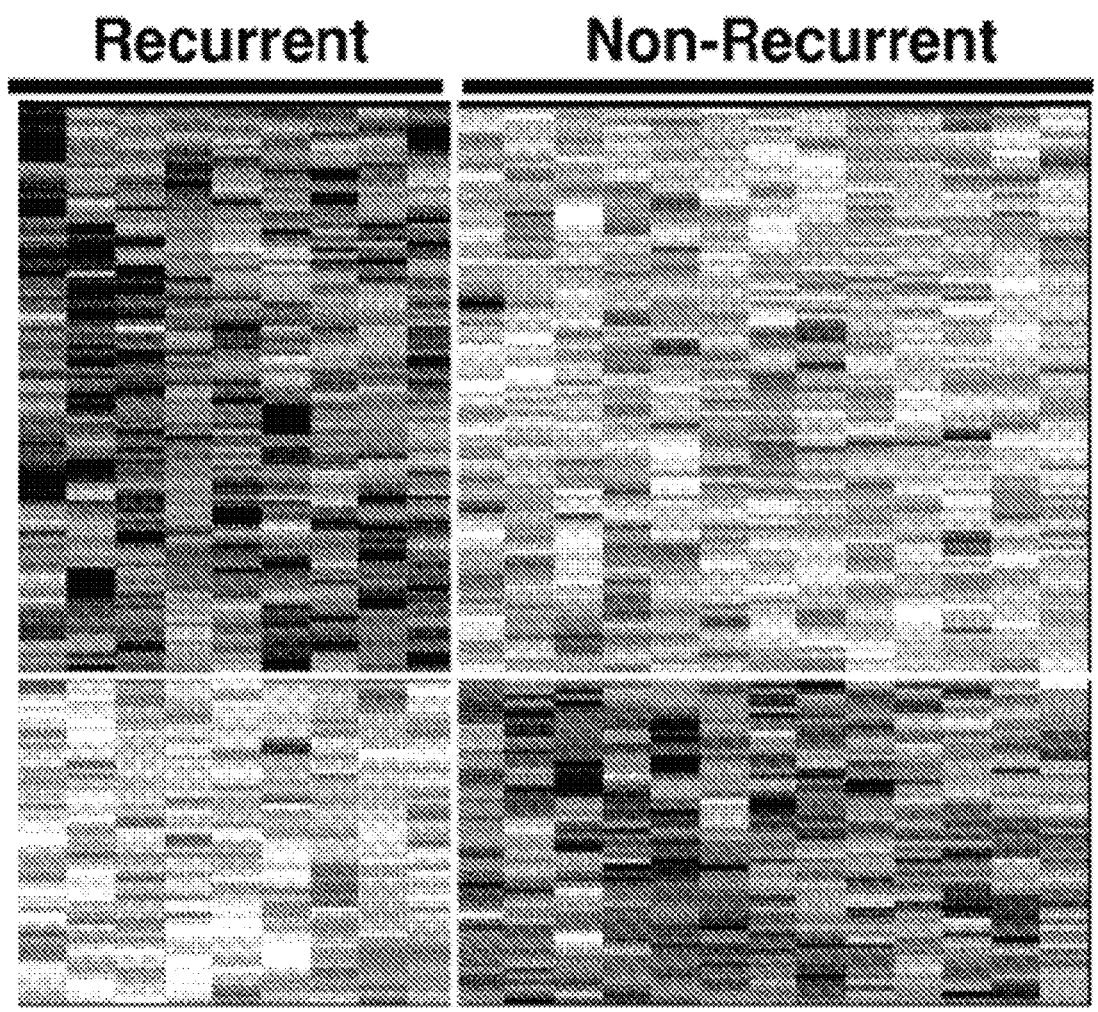

A linear regression filter was next employed to statistically rank target sequences that followed a trend of either increased expression with poor prognosis patients (i.e., SYS>PSA>NED) or increased expression in good prognosis patients (NED>PSA>SYS, alternatively decreased expression in poor prognosis patients) (Table 4). FIG. 1B depicts a two-way hierarchical clustering dendrogram and expression matrix of top-ranked 526 target sequences and 22 tumor samples. Patients in the 'PSA' clinical status category displayed intermediate expression levels for genes expressed at increased levels in SYS (n=313) and NED (n=213), respectively (Table 4). FIG. 1C depicts a two-way hierarchical clustering dendrogram and expression matrix of 148 target sequences and 22 tumor samples. These target sequences were a subset of the differentially expressed transcripts (Table 3) filtered using a t-test to query 'recurrent' (i.e., 'SYS') and 'non-recurrent' (i.e., 'PSA' and 'NED') patient samples (Table 5).

The expression levels of these genes were summarized for each patient into a 'metagene' using a simple linear combination by taking the expression level and multiplying it by a weighting factor for each target sequence in the metagene signature and combining these values into a single variable.

Figure 2:
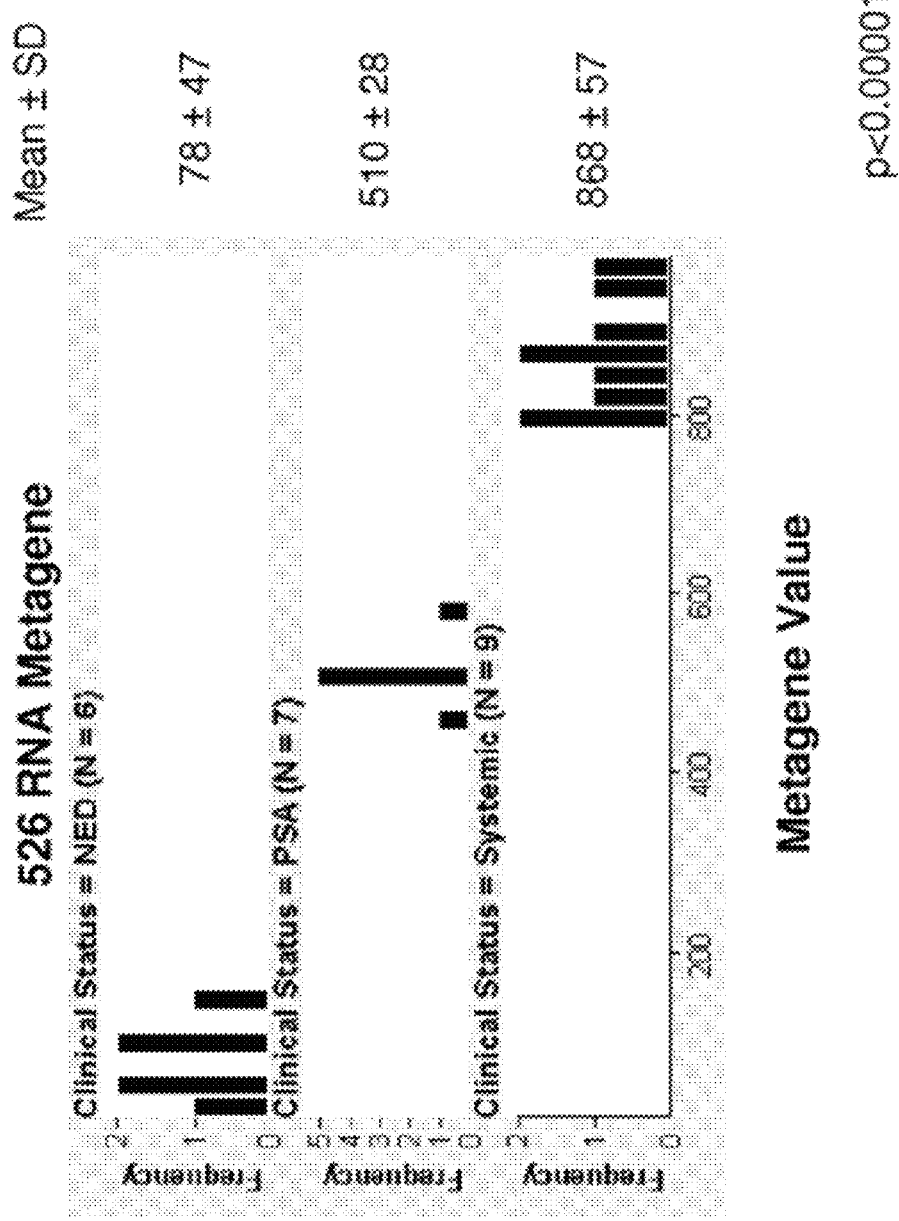
FIG. 2. Histograms showing distribution patient's tumor expression levels of a 'metagene' generated from a linear combination of the 526 RNAs for each clinical group. The histograms bin samples with similar metagene expression values and significantly separate three modes of patient metagene scores (ANOVA, $p<0.000001$) corresponding to the three clinical status groups evaluated.
Figure 3:
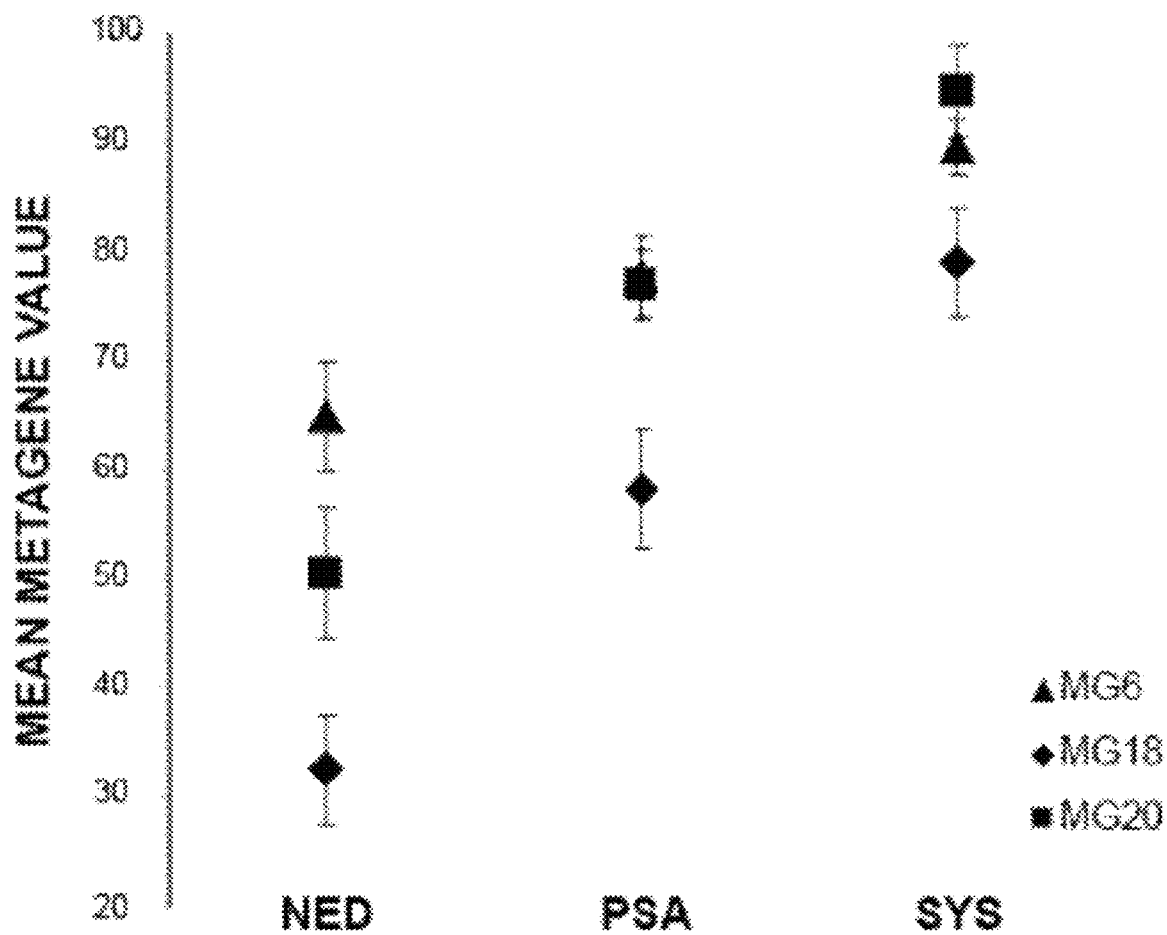
FIG. 3. Scatter plots summarizing the mean (±standard deviation) of metagene expression values for tumor samples from patients in the three clinical status groups (NED; PSA; SYS). Metagenes were generated from a linear combinations of 6 (▲), 18 (♦) or 20 (■) RNAs and demonstrate highly significant differential expression between clinical groups (ANOVA, $p<0.000001$).

Weighting factors were derived from the coefficients of the linear regression fit analysis (Table 4). FIG. 2 shows a histogram plot of the metagene expression values for the summarized 526 target sequences in each of the three clinical groups. This 526-metagene achieved maximal separation between clinical groups and low variance within each clinical group. Metagenes comprised of smaller subsets of 21, 18 and 6 target sequences were also generated (FIG. 3, Tables 7 and 8). The distinctions between clinical groups with respect to the metagene scores were preserved, although increased within-group variance was observed when using fewer target sequences (FIG. 3).

Figure 4:
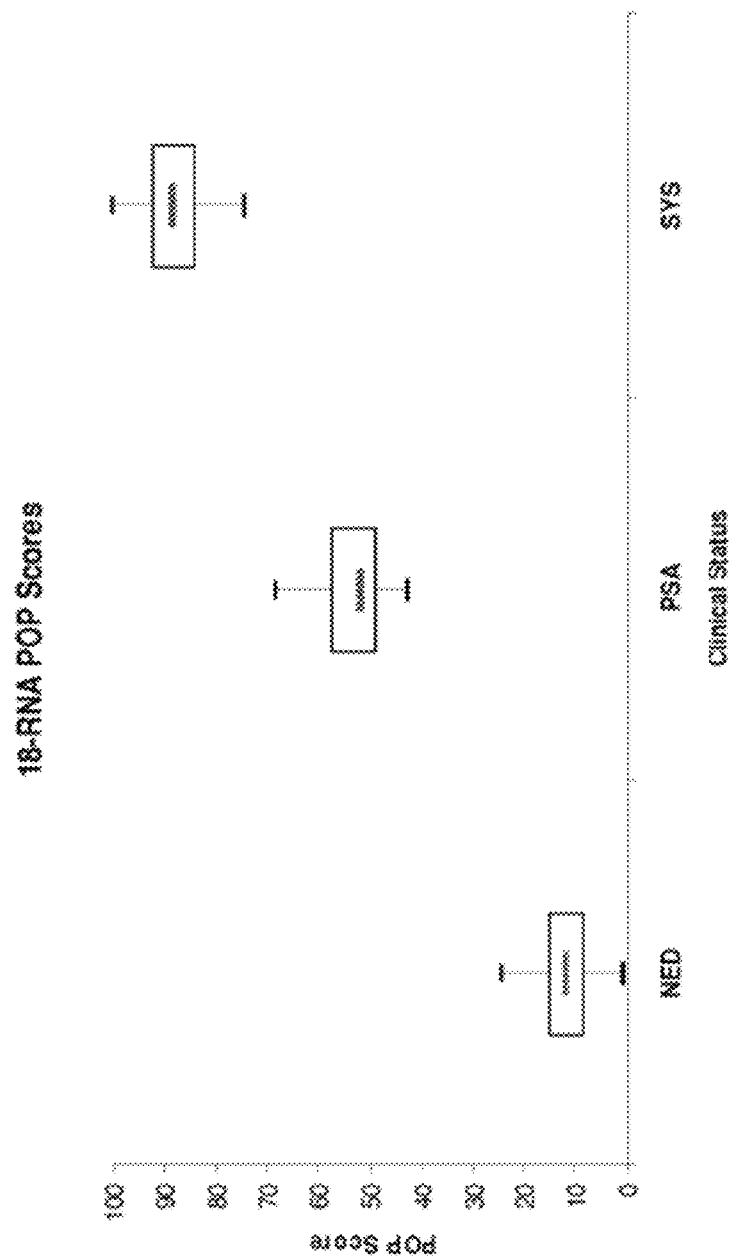
FIG. 4. Box plots showing interquartile range and distribution of 'POP' scores for each clinical group using an 18-target sequence metagene (Table 7) to derive patient outcome predictor scores scaled and normalized on a data range of 0-100 points. T-tests were used to evaluate the statistical significance of differences in POP scores between NED and PSA (*) as well as between PSA and SYS (**) clinical groups ($p<7\times10^{-7}$ and $p<1-10^{-6}$, respectively).

Next, Patient outcome predictor ('POP') scores were generated from the metagene values for each patient. For the 18-target sequences metagene, this entailed scaling and normalizing the metagene scores within a range of 0 to 100, where a value of between 0-20 points indicates a patient with NED, 40-60 points a patient with PSA recurrence and 80-100 points a patient with SYS metastatic disease (FIG. 4). In contrast, Gleason scores for patients could not be used on their own to distinguish the clinical groups (Table 1).

Figure 5:
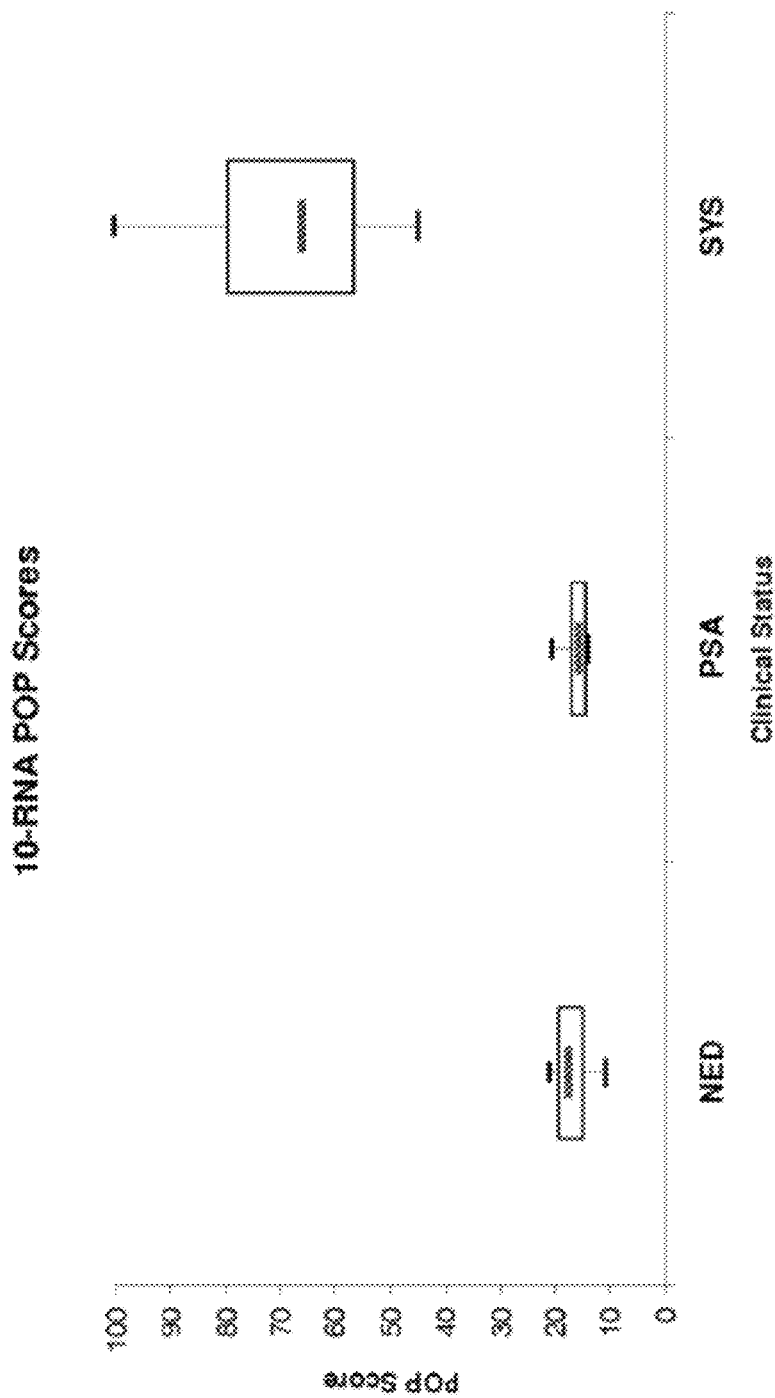
FIG. 5. Box plots showing interquartile range and distribution of 'POP' scores for each clinical group using a 10-target sequence metagene (Table 9) to derive patient outcome predictor scores scaled and normalized on a data range of 0-100 points. T-tests were used to evaluate the statistical significance of differences in POP scores between 'recurrent' (i.e., 'SYS') and non-recurrent (i.e., 'PSA' and 'NED') patient groups (**, $p<4\times10^{-10}$).
Figure 6:
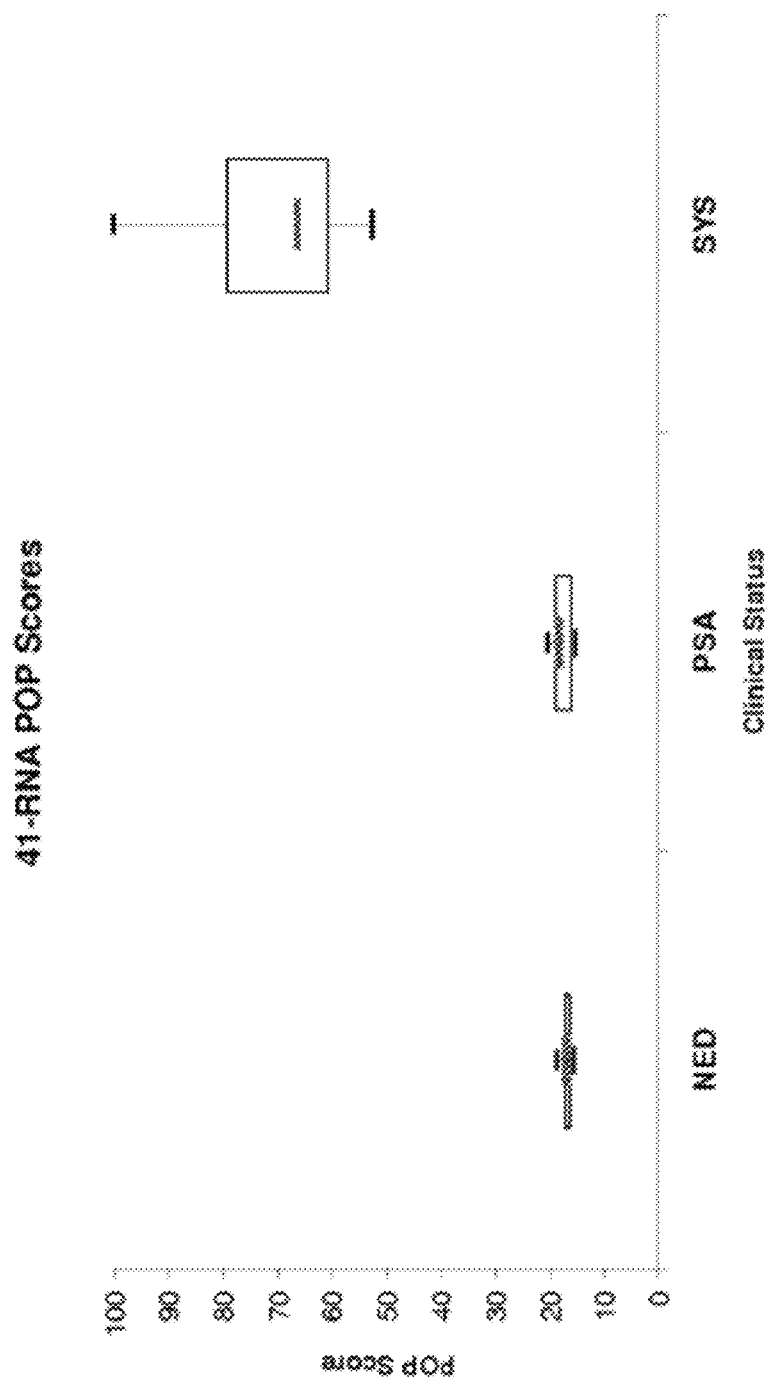
FIG. 6. Box plots showing interquartile range and distribution of 'POP' scores for each clinical group using a 41-target sequence metagene (Table 10) to derive patient outcome predictor scores scaled and normalized on a data range of 0-100 points. T-tests were used to evaluate the statistical significance of differences in POP scores between 'recurrent' (i.e., 'SYS') and non-recurrent (i.e., 'PSA' and 'NED') patient groups (**, $p<2\times10^{-11}$).
Figure 7:
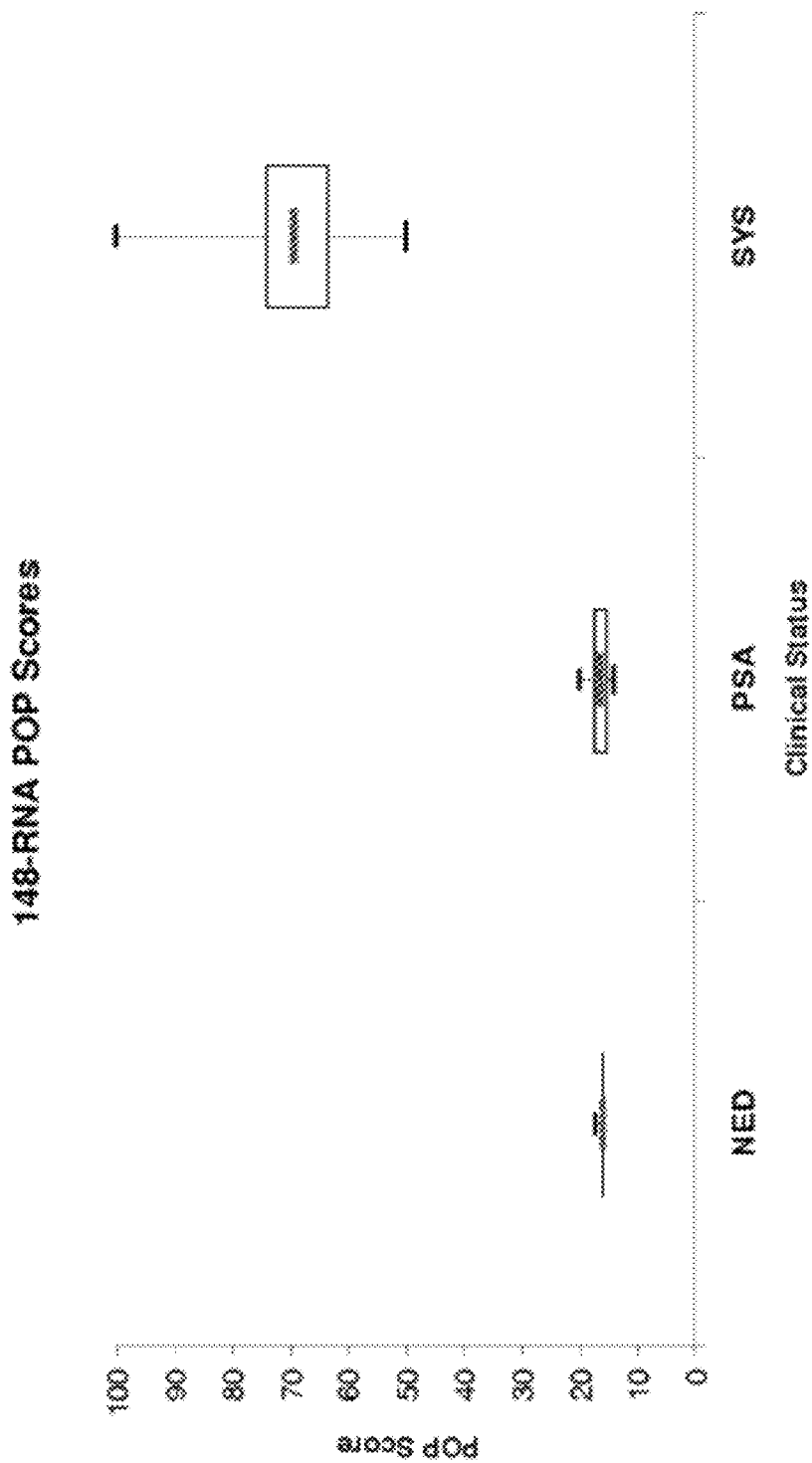
FIG. 7. Box plots showing interquartile range and distribution of 'POP' scores for each clinical group using a 148-target sequence metagene to derive patient outcome predictor scores scaled and normalized on a data range of 0-100 points. T-tests were used to evaluate the statistical significance of differences in POP scores between 'recurrent' (i.e., 'SYS') and non-recurrent (i.e., 'PSA' and 'NED') patient groups (**, $p<9\times10^{-12}$).

Using the Nearest Shrunken Centroids (NSC) algorithm with leave-1-out cross-validation, smaller subsets of RNA transcripts were identified that distinguish 'recurrent' (i.e., 'SYS') and 'non-recurrent' (i.e., 'PSA' and 'NED') disease (Tables 9 and 10). NSC algorithm identified 10- and 41-target sequence metagenes used to derive patient outcome predictor scores scaled and normalized on a data range of 0-100 points. FIGS. 5 and 6 depict box plots showing interquartile range and distribution of 'POP' scores for each clinical group. A 148-target sequence metagene (Table 5) was similarly used to derive 'POP' scores depicted in FIG. 7. T-tests were used to evaluate the statistical significance of differences in POP scores between 'recurrent' (i.e., 'SYS') and non-recurrent (i.e., 'PSA' and 'NED') patient groups (indicated in the figures) and show that increasing the number of target sequences in the metagene combination increases the significance level of the differences in POP scores.

The data generated from such methods can be used to determine a prognosis for disease outcome, and/or to recommend or designate one or more treatment modalities for patients, to produce patient reports, and to prepare expression profiles.

Lengthy table referenced here

US10865452-20201215-T00001

Please refer to the end of the specification for access instructions.

Lengthy table referenced here

US10865452-20201215-T00002

Please refer to the end of the specification for access instructions.

Lengthy table referenced here

US10865452-20201215-T00003

Please refer to the end of the specification for access instructions.

Lengthy table referenced here

US10865452-20201215-T00004

Please refer to the end of the specification for access instructions.

Lengthy table referenced here

US10865452-20201215-T00005

Please refer to the end of the specification for access instructions.

Lengthy table referenced here

US10865452-20201215-T00006

Please refer to the end of the specification for access instructions.

Lengthy table referenced here

US10865452-20201215-T00007

Please refer to the end of the specification for access instructions.

Lengthy table referenced here

US10865452-20201215-T00008

Please refer to the end of the specification for access instructions.

Lengthy table referenced here

US10865452-20201215-T00009

Please refer to the end of the specification for access instructions.

Lengthy table referenced here

US10865452-20201215-T00010

Please refer to the end of the specification for access instructions.

Although the invention has been described with reference to certain specific embodiments, various modifications thereof will be apparent to those skilled in the art without departing from the spirit and scope of the invention. All such modifications as would be apparent to one skilled in the art are intended to be included within the scope of the following claims.

LENGTHY TABLES

The patent contains a lengthy table section. A copy of the table is available in electronic form from the USPTO web site (https://seqdata.uspto.gov/?pageRequest=docDetail&DocID=US10865452B2). An electronic copy of the table will also be available from the USPTO upon request and payment of the fee set forth in 37 CFR 1.19(b)(3).

SEQUENCE LISTING (2114 sequences)

SEQ ID NO: 1 - DNA, 139 bp, Artificial Sequence
  Affymetrix ID 3509278
ctggtccctctcctgatagagtttcaggtttgccctgatgatctagatgaagcaaagtgtggtgacacttcgctgaatgctctgtcagtgtgcctagaaatagagtctctatcagggccgtttgcttcctatcacactc

SEQ ID NO: 2 - DNA, 26 bp, Artificial Sequence
  Affymetrix ID 2750440
ggcatgatctaggctaactccctggc

SEQ ID NO: 3 - DNA, 27 bp, Artificial Sequence
  Affymetrix ID 3498665
tgggcaagagcttttgtatgtttccag

SEQ ID NO: 4 - DNA, 105 bp, Artificial Sequence
  Affymetrix ID 3159532
cccaacacggtgcagccgatttatttatttttccctcagcatttttaggtggattgactgggatgctttattcaactcagggacgcaccacgaatatgttttttg

SEQ ID NO: 5 - DNA, 26 bp, Artificial Sequence
  Affymetrix ID 3521600
tggcgccagcgaaagccacgaacgtg

SEQ ID NO: 6 - DNA, 69 bp, Artificial Sequence
  Affymetrix ID 3820597
gctgggcgcagcgttctgaggggatgtggggtctgggaggtgtctcgaggtgagagctccaagtcacgg

SEQ ID NO: 7 - DNA, 371 bp, Artificial Sequence
  Affymetrix ID 3955349
gtggcgcaatattgcaatacagctcactgctacagccccaggcttaagtgatcttcttgcctcagtctcccgagtagctggaaccacaatctcataccaccacgccccacgcctggtaaatttttaaatgtttttgtaaagacagggtactgctgtgttgcccaggctggtctctaattcctagtctcaagcgatccttccgctttggcctcccaaagcactgggattacaggtgtgagccactgtgcccagccctgctctaggttttcatttggatttgctgcctagtggaaggcacaggatggggcagtgccttctgccagtgagggaggctccaggtagatgtcattgctgaactggagctcccctgg

SEQ ID NO: 8 - DNA, 336 bp, Artificial Sequence
  Affymetrix ID 3204523
tgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggtt

SEQ ID NO: 9 - DNA, 325 bp, Artificial Sequence
  Affymetrix ID 3373899
agccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttc

SEQ ID NO: 10 - DNA, 25 bp, Artificial Sequence
  Affymetrix ID 3707645
atggcgcagccgggcccggcttccc

SEQ ID NO: 11 - DNA, 495 bp, Artificial Sequence
  Affymetrix ID 3860354
ttcagattcacgagggtaatccagatgaaggtatatcattgtacctggcccgcatcactcagtaactgtcacctttgatttattgatttacttgagatggagtttggttctgtccccgaggccggagtgcaatggcgtgatctctgctcactacaacctctgcctcccaggttcagagtgattctcctgcctcagcctctttagctgggattacaggcacccaccaacatgcccagctaatttttgtatttttagtagagaggagctttcaccataatggccaggctggtcttgaacctcaaatgatctgcccaccttggcctcccaaagtgctaggattacaggctggagctacagagcccagcctgtcaccttgatttaaatgaatgcagctttcttggtgtcttgatgtttgtgaatttctgtggagtttgatactgctccttttgctgcttgtttttccagagtccccttatcacttgacgtgctgttata

SEQ ID NO: 12 - DNA, 365 bp, Artificial Sequence
  Affymetrix ID 2406772
tgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggc

SEQ ID NO: 13 - DNA, 72 bp, Artificial Sequence
  Affymetrix ID 3881324
ttatgaatttgacaccaaggacctggtgtgcctgggcctgagcagcatcgttggcgtctggtacctgctgag

SEQ ID NO: 14 - DNA, 107 bp, Artificial Sequence
  Affymetrix ID 3271321
aggagcaggtcgtcaagtccaccaggatggaatgctcagtaggagaaattgcgctgtggggccatttgaggcgcctgtccatgcgggtccgtcctggcccttctgaa

SEQ ID NO: 15 - DNA, 150 bp, Artificial Sequence
  Affymetrix ID 3316374
aggcattacgccagctcccggatgcctcagcctcgtgaattcggggtaggacgctcagggcccatggtcagcacagcgggtgggtgggtttcagcgtggtcacttctccaggggtgcataattgagcagcttctcgatcaggtccacgtg

SEQ ID NO: 16 - DNA, 136 bp, Artificial Sequence
  Affymetrix ID 3333695
gttgaggagcttgatgctgcagtgagattgtgccactgcactccagcatgggtgacatagcaagactgcctcagggggaaaaaaaaaaaaaaacaccaaaaaaaaaggtatatggaccctagttttggccaggctg

SEQ ID NO: 17 - DNA, 25 bp, Artificial Sequence
  Affymetrix ID 3930855
gtggctcactgtagcgtcagtctcc

SEQ ID NO: 18 - DNA, 268 bp, Artificial Sequence
  Affymetrix ID 2945934
ggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaaca

SEQ ID NO: 19 - DNA, 91 bp, Artificial Sequence
  Affymetrix ID 2581405
ttggtatgtagggttcgtatgaatgaaacgtgactaccagggcagataatgaaaggctttcaatcccagagtaagagatatagggccaggc

SEQ ID NO: 20 - DNA, 147 bp, Artificial Sequence
  Affymetrix ID 2465840
atgtggcacaatttacgaaaaccaaagagaggctatgctgagtccctacaccaccaagaccgtgatgttctgcccactcgcctcctgatggcctgtggggatagaccagcttccagatttcacacagatgggctgtatggaggaggc

SEQ ID NO: 21 - DNA, 90 bp, Artificial Sequence
  Affymetrix ID 3431367
cgatctctcatggtgggctcaagtgatcctcccatctcagcctcccaagcacctgggactacaggtgcacatcaacacacccggataatt

SEQ ID NO: 22 - DNA, 190 bp, Artificial Sequence
  Affymetrix ID 3458114
gggccactgttcctcaagcatctaaagggcttccagcaaagaaaggccccacagctctgaaagaagtacttgttgccccagctccagaaagcacgccaatcatcacagctcccactcggaaaggtccacagaccaaaaagagttctgctacttcacctcctatatgcccagatccctcagctaagaatgg

SEQ ID NO: 23 - DNA, 190 bp, Artificial Sequence
  Affymetrix ID 3875254
ttctccctcagaccaagttaaactgtttttttcccaagagctaggaatcatatctgatcacactgggacttcccttcactgtcagtctaagagtttgcatttttgaggtttaggaaaagggaaaaaaaaggaagaaagaaagaaattgtatctgagaacaaagaagctgccacatggtccctcggtatca

SEQ ID NO: 24 - DNA, 115 bp, Artificial Sequence
  Affymetrix ID 2515646
tgtgctcaccgatatgaaaaaaggcagcatgttaatacgaagcaggaatcccgagacatctttgggcggtgttatgtcctgagtcagaatctcaggattgaagacgatatggatg

SEQ ID NO: 25 - DNA, 155 bp, Artificial Sequence
  Affymetrix ID 3202904
tgagggcgttggaccacacacccttgaaaaaggcctcgccccgctcatctctgaagatcttcctccaacagtcgacggtgcccgtgtacatgatgtcagctcctttgcgccgggactgcatcatcgtccgccgccgcactgtgtcgaagggttag

SEQ ID NO: 26 - DNA, 38 bp, Artificial Sequence
  Affymetrix ID 2768304
ctgtccaccttgtgatcaaaactgtggacggactttag

SEQ ID NO: 27 - DNA, 268 bp, Artificial Sequence
  Affymetrix ID 3736631
aaagcggtcactggccatatgatgcggagatggttttatctgaggcctgagaaccaacagatgtgcctgcgccctggcctgtgcagctgtgggcagatgtgtccccaggggcctgccctcactcgtgaccatgcaataccctgcaacataaacattttcttttccaaggatctgcaggggtggacatgatgctccaggcacagagtaggaagaaaagggggtgacctggggttcccagcaaacaggtccacctcatgctcactgcgtt

SEQ ID NO: 28 - DNA, 60 bp, Artificial Sequence
  Affymetrix ID 2787529
tgtgccctggtatgtgaatgtacagccccggaaagtgtgagcggaaaagataacttacct

SEQ ID NO: 29 - DNA, 25 bp, Artificial Sequence
  Affymetrix ID 2980188
tttccccacaaattgctgatgtacc

SEQ ID NO: 30 - DNA, 128 bp, Artificial Sequence
  Affymetrix ID 3273235
caatattcactgtgaggtcaagctcctagaggtaaaaactcaaaactgtggcagccctcccccgtgactgggtccctctgaagtttctaactctcagagttgtccatactgggcatctagcgattcat

SEQ ID NO: 31 - DNA, 69 bp, Artificial Sequence
  Affymetrix ID 3402918
gaggaaaagatcaagtgcctggccacagagaaggtgaagtacacccagcgagttgactacatcatgcag

SEQ ID NO: 32 - DNA, 213 bp, Artificial Sequence
  Affymetrix ID 3529227
cgaagtgggtctccaaattccgcgcccaccccaccgcccgagaagcccactacgcatgcgtccgcaccccaccggcgccccttcctattgagcatgcgcgggagccccacctatttctctctaccgtttcctccccctacctggtaccccatccctagctcagccattgcttttttttccacgaccctccgctgtttcttccgcgagcttcct

SEQ ID NO: 33 - DNA, 45 bp, Artificial Sequence
  Affymetrix ID 3839571
ggagggaatggctgtgtcccacaggaataacagcgggatgcttcc

SEQ ID NO: 34 - DNA, 80 bp, Artificial Sequence
  Affymetrix ID 2697538
gagactcgttgggtgatcatttcattgagatcaacctgaatgaccaggtgtaaagtgcaagagtaatatgctatgactga

SEQ ID NO: 35 - DNA, 677 bp, Artificial Sequence
  Affymetrix ID 2521076
ggatccatgccagacaacgcacattctgcagacactggttactccagtggctccttactggaaacatataatatcagtgataagtgctgtgaagaaaataaaacaatgatgtgctggtatggatttttaacttttttatgtgatgaaccacagaatgatggttttaaatgtatgaaatacatagaattgcaacagaaaccagttatgaaataatgaagatattaaatatgacatctatattttagtaaagcattagtgaggactgtaaatgatctttaaagaatttggcttaaatttaatctaaaattgctatcaggtatttcacatcgctgtaatttttgcctgcattcgtaactgaagagataagtaaatgtcagaggttaagataaatctttttctttttttacctgtccatatttacaaacattctgcgttccgtacatagacgcctggataagaacccctgtgcaagaatgactttggtgctactttaaaaaaagtggttggggaagacctcataggaaatgacatcaataatagattgcatgataacctatactagttcttactgttaccaatttaaattctaactgcttaaaagctaacacggtccttccctttttttgagcacctgatttgaagtactttgagtaggcctcaagtgtcgtatgcaagta

SEQ ID NO: 36 - DNA, 150 bp, Artificial Sequence
  Affymetrix ID 2811029
ctgagttctgatttggagcagcctgtcgcaataccaaatcacctttgaataaacttatcctctcagcttttattgttcagaattgatttcgaggatagaaattccatttccttgtcatatatacctgagccgttgcatcaaattgtcaga

SEQ ID NO: 37 - DNA, 28 bp, Artificial Sequence
  Affymetrix ID 2735920
gggtgtagcgcaccaagcatgagctgaa

SEQ ID NO: 38 - DNA, 1302 bp, Artificial Sequence
  Affymetrix ID 3843767
aataacctagcatggggcggcactaaatggctgcaggaaagccgagtcttcttccacatccggcggctcccctcggatgcgagcgctggcccagggtgtgtttacagaggtgagggcttcccgtggacccttctcgttgggagcgcttagcctcaggagcggattcagggcacaggcagaggacgtccacaaacaccacaggaagccgccacccaggggcgtggaaaggcccaatgcctcgtctgggattcacggccggcaaagcggcccctccggaacgggacagcacagcggctcacctctgcgcctctgggggtgcggggggagcctcgccctccacgctctctgggggaccgcccgccctagcccccgcctgggcttcgcgggtggacggttgggggccccgggcgccccccagcgcgtagcttttctccttctcgtgggtcttctggtgctcggctagggccaggctgaagtggaaggtcttccagcagccctgacaggcgtagcgcttccggccgccatggctgctgtggtgctccatcaggtgcgagagccacgcgaaggcctccccgcactcgccgcaggcatagggcttcccgcgggacaagcccggctcgtcagccccagggccctgcccggcctccagccctgcgctgtcgccggagctagagacgccctcgaggctctgcccgtccccatcctcggggtgcggcctcttggttcccagtttcgccgtgcccctgtccggggcaggctgctggatgacggactgcctctgcgatccggtggcagagtcggactccgcgtcctgggggtcctgcgggtccggggccttcccaggctgctcttcctcctcctcagtggtgcccgacgggggatcggcaagggcgtccccagggggcgcctccgtaggcagctcaggcagcacccccgcgggggcggcctcctcgcaggcgcacccagcgctctcctgccgcctcccgccttctggaacaaggtcagagccctagcgtgagcgccccgcccagggccagggagaggaggacccagccgagcctcagctgccggaacagcgcacagggctccgggctctggatccccgcggggctcacggctgtttggaagcagcgctgtccctcccaggcagccctgcagcgcatgccccgcgcctgctgctgcagatgtgggacctggaggcctccaacaacggaggccaccgacaggacaggaaggacagccccactgagcccgggttctggaaaccgcgcctttggaggtctccacctggccactagcttg

SEQ ID NO: 39 - DNA, 1459 bp, Artificial Sequence
  Affymetrix ID 3895275
tgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatg

SEQ ID NO: 40 - DNA, 1047 bp, Artificial Sequence
  Affymetrix ID 4031098
tcacttaacatagtgccagggcatgcaattttgtttcttactctctggatgtgggatatgcgagtgtgtgtgtgtgtgtgtgtgtgtgtgtattaagctttctgtttctgatgaaattttcatatgaaatttactggagataagattaaattagtggaaaaacaagataattttgctttctatgtagtggtcaccaagttaaagaattgtgccagttattaggcaagataggctttgagatttagggacagttaaattttacaccaacttagtgaacatgagacttctacctagtgttacatttcatttttaaataagcaatttaaaaattggtaaatgatttgtttactttgattatattctggtataattttctgacaaaattatctgtgtcttggtcagcattgttgctagaatatgtattcagattttgtctgtccataattgagaacacagaaaaaatctaatttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttc

SEQ ID NO: 41 - DNA, 25 bp, Artificial Sequence
  Affymetrix ID 2927637
gtcccacaggatttcgggaatcaag

SEQ ID NO: 42 - DNA, 51 bp, Artificial Sequence
  Affymetrix ID 3839575
ttctgaagcatcaaagccttagaccagatgaagactccagccatgacctca

SEQ ID NO: 43 - DNA, 64 bp, Artificial Sequence
  Affymetrix ID 2566620
atccattgatggtttgatagtgggctgggaaggaaagctgtgttcctccacattaggcagcaaa

SEQ ID NO: 44 - DNA, 47 bp, Artificial Sequence
  Affymetrix ID 2959903
tcatttatttgacagtgcatgtctgcaatgccgtgctcatcaatgat

SEQ ID NO: 45 - DNA, 32 bp, Artificial Sequence
  Affymetrix ID 3100926
agtaacagctatccaccaatgtcaatccatac

SEQ ID NO: 46 - DNA, 26 bp, Artificial Sequence
  Affymetrix ID 3853655
gcaggcaatatctccgcacctttaat

SEQ ID NO: 47 - DNA, 146 bp, Artificial Sequence
  Affymetrix ID 3947544
ctgctggaacgacaccaactctttgcctcccatccttggttggatatgatttgaaatttggtaatgtgtctctacttgaaacagatgcactgtttggatgttttcaggtcggtgatctacttgtccagtttgatcgctaccagaag

SEQ ID NO: 48 - DNA, 371 bp, Artificial Sequence
  Affymetrix ID 2466070
ggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgta

SEQ ID NO: 49 - DNA, 115 bp, Artificial Sequence
  Affymetrix ID 3065818
ttcgataggtttgaggggaagctcagccctctgtggtacaagataacaggtgcccaggttggaactggctgtggaacacttaacgatggcaaatctctctacttcaatggccctg

SEQ ID NO: 50 - DNA, 49 bp, Artificial Sequence
  Affymetrix ID 3332183
ctgatttcactccagactggtgtggccacccttgtcttcagatgagaat

SEQ ID NO: 51 - DNA, 181 bp, Artificial Sequence
  Affymetrix ID 3681410
ctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccg

SEQ ID NO: 52 - DNA, 71 bp, Artificial Sequence
  Affymetrix ID 3873342
gccacaggagggtttaaacacagcagtaatgagactttatttctgctgggaaaacattgccgttattgccc

SEQ ID NO: 53 - DNA, 273 bp, Artificial Sequence
  Affymetrix ID 2572055
gtgcctgagagaaaacggcctaatcgaaaacgtccgcggcatacatccattcttaaaacttgagtggctgcttttctgggtggaaaagagcggtatcagacagggtgagcagtcggggaacggatgaacaaagacttgcaccgtggccctgatgcctttgttccgagttctattcagttgtacttgtgcgttgttacaggactttagaatgcagccctgccccccaacccccacctcccagggccgacctgtgctcctaggaaggcaaacctc

SEQ ID NO: 54 - DNA, 396 bp, Artificial Sequence
  Affymetrix ID 3434549
tggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattgg

SEQ ID NO: 55 - DNA, 222 bp, Artificial Sequence
  Affymetrix ID 4007482
tccaagcaggtcttcgtagtagagaacgaaccagccctcgatcaccaggtgaatgaacccacacactgcaaaccagcacagggacagtcgccgccaagtccccaatgggacaaccgcagcacgacctgacaacagccatgtggtcacgactaagacccctgtgacagagaagaggccagccagtatatgccaggtggggcggtcattaggtacaaagttgtc

SEQ ID NO: 56 - DNA, 346 bp, Artificial Sequence
  Affymetrix ID 2751391
cccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctga

SEQ ID NO: 57 - DNA, 103 bp, Artificial Sequence
  Affymetrix ID 2871645
ctctgtggggttcggttccactttgtagttcgggtttgtaatgtaaagaataatgggaaactggtctaattatgagagttaagagagtagaggcctgtagttg

SEQ ID NO: 58 - DNA, 133 bp, Artificial Sequence
  Affymetrix ID 3629576
ttagccataatagggcccggtacgatttgggagtgacatttctgtaaagaagaggaaaaatcatttttctataatttgtaaagttgtgaaagagccactaccacagtttttacattgattattggaacatttc

SEQ ID NO: 59 - DNA, 87 bp, Artificial Sequence
  Affymetrix ID 2545930
tggtggctacaacattggcaccgtcagccatgagagccgtgtggattggctggaacttaatgagactggacacaagctcctcttcag

SEQ ID NO: 60 - DNA, 104 bp, Artificial Sequence
  Affymetrix ID 2569734
ttcccttggctttggacatgtgagggaagtaggtatccgctgcctggggaaagtcaacaggacccctcctccccgtacctcttggtatacaaagctgagcggtg

SEQ ID NO: 61 - DNA, 66 bp, Artificial Sequence
  Affymetrix ID 2832639
ttactttgaagtttgcggcatgatggtggaaagtgtaaatgctaaaacactgatgagtagaatttg

SEQ ID NO: 62 - DNA, 1053 bp, Artificial Sequence
  Affymetrix ID 3113343
ggctgattgaccttgactggcctcatgtatgtgtctcaaagttggctggggctgtcggctgaaattccttagttctactccacatggcctttccccatggccagcccaggctgagatctgagattgaagagggtgagaacagaaagtacaagatcttcttttgacttgaaagctagcccagaatcgagggaaataaaccccaccttttgatggaaggagcttcaaagaatttgtagtcatttccaatccacgaagagtaggtacccactatttgttgaataaagccctattgaaagctttttagctatccagatgcaaattactggccaacctttgggtagaattataaaattctgcccaaaattctaccaaattactggtacttgtaaaattctaccaaataactggccaacttttgggtagaattgtaaaaattaagttgtaaataaagcctattgcctaacaggaacttcaaagtcagagaatcctaaaatgattgtgctacacagggccacatagagcacagctttgtctttttttttttgagatggagtctcgctctgtcccccaggctgaagtgcagtggcgcaatctttgctcaaggcaacttctacttcccaagttcaagcaattcttctgtttgagcctcctgagtagtgggactgcaggcatgtgccactatgccccattatgtatttttagtagagatgagatttcaccagattggccaggctggtctcgaactcctgacctcaaatgatctgcctgcctcggcctcccaaagtgttgggattataggcatgagccaccatgcccgcccgcttcgtcttttcactggactaatgaagatacaggtgtggaatggtttcacagcatgcccaacctcatgaggcttgttgggtcagagcttgtgccagatgccagtcttctgccttccagtcttatagttgttacgctatagccttctgcagtggatggtaacgtggccaaaataagcctttggttttggagtattcgtaaaatgaaagtggtgccatctaccttaatgctggg

SEQ ID NO: 63 - DNA, 228 bp, Artificial Sequence
  Affymetrix ID 3875673
gggaactaacgccttccagaacagaaatatgtggtccgatgagtattgaatgcaacttaaaatctagttggaatgtgatggataagaagagacccaaagtcatcaacaagccttctcatgaactttcagtcattaaccttcctatatagtaaggacagaaatgatgatttaagccatcttaggcaaggcagtgctaacaatatgcttttgtaaagtcaccatccggtg

SEQ ID NO: 64 - DNA, 389 bp, Artificial Sequence
  Affymetrix ID 3959071
ttctctaattctaggcctgccgtttttctctgtgagtggacctgatctccttttgctttggctcccagagttccctattcgcttctccttgtcccctgagtcctgctctccctcctctggataaccccttccagcccttcacttctccctcctgttatttgctggaatggctaattggctgacccccccacccagtccccatgggagaccccctccagcaccagaagaggcagactaacattttctttggtagcagaatgtaaaattgtaaaatgtgaaagataggagagaaacatcattaactgttctgttatttattaacattttaatttatagaattatagacttaacagcaaaaattcaaacactgagggtcatcggtgaaaata

SEQ ID NO: 65 - DNA, 145 bp, Artificial Sequence
  Affymetrix ID 2864793
gcctattggcttcaagttgtttacgctttggtaggttttggcttgttccctcaaaggatcccttcttcatgtcctcccatgatgttgcaggcaagggtctcttgttatatgtggtactaactcgggcccacctggtcataatttc

SEQ ID NO: 66 - DNA, 80 bp, Artificial Sequence
  Affymetrix ID 2976430
gctcctacagtaacactcaatcaattcaccccactccagtgttcttcctgcaacatcactgatttagatggcccactctg

SEQ ID NO: 67 - DNA, 41 bp, Artificial Sequence
  Affymetrix ID 3862771
gggaatctattaatagtggaggaagtatttagtgggtggga

SEQ ID NO: 68 - DNA, 89 bp, Artificial Sequence
  Affymetrix ID 3192159
tggatatatggcattgacccgcttgctttgatacgaaacaaaaaagcagacgactccttcatcccatctgctcctaccgtgactgtgga

SEQ ID NO: 69 - DNA, 285 bp, Artificial Sequence
  Affymetrix ID 3062031
gggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagacttaaagaaataagaggcacatcaatcaattgaaatgtgtgggaccttacctggactctgaatta

SEQ ID NO: 70 - DNA, 62 bp, Artificial Sequence
  Affymetrix ID 2505555
gagcagtacaggttcctgtaccacacggtggctcagatgttctgctccacactccagaatgc

SEQ ID NO: 71 - DNA, 25 bp, Artificial Sequence
  Affymetrix ID 2361309
gagccggacttccttgtcccaccag

SEQ ID NO: 72 - DNA, 36 bp, Artificial Sequence
  Affymetrix ID 3569829
gtactcgcctcctgcatggagcacgctcaggggtgg

SEQ ID NO: 73 - DNA, 42 bp, Artificial Sequence
  Affymetrix ID 2946327
ttactgttgctgtccgtaaactggaacctctgttcactcaag

SEQ ID NO: 74 - DNA, 273 bp, Artificial Sequence
  Affymetrix ID 2751432
ggaactcctcagaacttataatatgttgatattctttgattcccagatgaggggatgggtaataggatacatggttttccagacttgtttgaaaatgcaactatttttgggttgcagggaaggatatagtagaactcatgggaactggtgtttcttggaacatgctttggaaatgctgggttatgccctgttaactcttacatcattagtttttagcccaaaaggaaacagcaaataatgttttatatgagccacattttgcgttgattttcc

SEQ ID NO: 75 - DNA, 107 bp, Artificial Sequence
  Affymetrix ID 3907608
ggacgtctacggaagtggagcacctccaccaagagccaagaggaagagggaccagaggaggaggacgatgatgacattgtagacgctggagccattgatgacctgga

SEQ ID NO: 76 - DNA, 27 bp, Artificial Sequence
  Affymetrix ID 2316543
atgagacctcagacaaagccaccagga

SEQ ID NO: 77 - DNA, 331 bp, Artificial Sequence
  Affymetrix ID 2453070
tgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcc

SEQ ID NO: 78 - DNA, 126 bp, Artificial Sequence
  Affymetrix ID 3119603
tccagctggcagcaagcaccgagcatgccctccccacccagaggacctccgggcaatgcctgtcccgcctcatgctggaggctgcctcgggcacctgcctgcccattaaagactggtcagacctgt

SEQ ID NO: 79 - DNA, 126 bp, Artificial Sequence
  Affymetrix ID 3908801
cactgcagaaggaacgggcaccaacaagaaggtggccaagcgcaatgcagccgagaacatgctggagatccttggtttcaaagtcccgcaggcgcagcccaccaaacccgcactcaagtcagagga

SEQ ID NO: 80 - DNA, 115 bp, Artificial Sequence
  Affymetrix ID 2525664
gaagctgttttaatggaggccgagagttggacaattttgtgttatggagaattctgggaagaaggaaagacccggatgggactgtttattaaggcttatgactggactggagata

SEQ ID NO: 81 - DNA, 106 bp, Artificial Sequence
  Affymetrix ID 2395926
tacgggaaagaacatcaatataagctgaccgtcactgcctatgactgtgggaagaaaagagccacagaagatgttttggtgaagatcagcattaagcccacctgca

SEQ ID NO: 82 - DNA, 72 bp, Artificial Sequence
  Affymetrix ID 2571145
ctcaaaagtgtttattacatctgacctatgtgggcaaaagttcctgtgctttttagtagagtcccagctcca

SEQ ID NO: 83 - DNA, 1662 bp, Artificial Sequence
  Affymetrix ID 2836006
ggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttg

SEQ ID NO: 84 - DNA, 1054 bp, Artificial Sequence
  Affymetrix ID 2517773
tagcggagaatgacctacctacttgattaatgatgtctgcatgggcttactaagagggtgtggggaatggtggcaggggtaactatcatcgagaatatagggcaatgggtatattctaactttgcataactttgctagattatatatatctttactcacaataagcaaagttgaacaacttaaaattgattccctgttttctgttttcactatccaactaggatgaactcttaagttcatacatatactttaaaatgggaacaaacatagcctgtcatgtctttatttaggctaagtgcatatgtatgtataagtaatgtgtatatccttcacttattaatagtgccttcatgaattcaaagacccttgtcacatggtgctcaggaaaaaaaaagtgccaatattctttttttttttttctctaagaagtactagtttaggtaagtgaaattcaatagcatatcagtgctttaccttagtcactttttgtgttttgatcacccttagtcatcactggagagaagagtttgaattcatttgtggttttgctttagtggcaaacctccttacagggatgagttgccctccattctccttgccatatttggttaatctaggccatgacctttgaggggaaaaggcacagattgcaacttttctttcctgcttttgtgaatcaggccatgttcacgcagggtccttgaaggtgacttgagtgaggaagctatataccgatgacttaccaatttttggtcttataacattctctctctttttttttttttttttttgtagcatatggcttcctctactgtatgttggcatttgccacttttggggatttgactcctgcaggtatttttttttttttcttttgggggagtgtgacggcagtggatatagtcttagatgatgtttttaatagttcaagtccattagtgtcttactctagagaaaacgaaagactcactgtgtgagttttcttgccctctggttttcagaattctgtgtagtttctcaacatttcctttctacctgtcctgaagagctctta

SEQ ID NO: 85 - DNA, 25 bp, Artificial Sequence
  Affymetrix ID 3064957
aaatccacagccacatctttgaatg

SEQ ID NO: 86 - DNA, 40 bp, Artificial Sequence
  Affymetrix ID 3239181
tcattctcaccgcagagtcaaaatggccgagcaccccctc

SEQ ID NO: 87 - DNA, 81 bp, Artificial Sequence
  Affymetrix ID 3629017
tcaccatctataaggtctcagagcagaggattattcatggtaataagtgggggtgtggtgcagccattccagtaacaccca

SEQ ID NO: 88 - DNA, 744 bp, Artificial Sequence
  Affymetrix ID 3709453
ggtgggacttacaggtctcgctatagcaccagataaaatccatactacaccctatcattacctgggaatgagggtacaggagaaaacagtaaagcctcaaaaggaggaaattcgtaaagagtccttaaaaaccttaaatgatttccaaaaattattaggggacgttaattggataagacctactttaggaattcccacctaagcaatgtctaaactgtttgctttgctgagatgggatccaaattcatgtagcaaaagaactctgatgcctgctgcagctgaagagttacaaatgattgaggaaaaaattcaaagtgctcaagtccgtagaagagatcctagtgttccattacagctcttagtgttccctactctccattctcctataggagtgattgttcaaaatgttgacttagttaaattgtcctttttaacgcacagtacgactagaactttctcaatttatttagatcaaatagctattcttataggccaaatacaactgagaatagtcagactcattggcaccgatcgagataaaaatgtagttcctttaaacaaagcacaggttcgacaagcctttattaattcgtcagaatggcagtcaaatctggctgattttgttggcagtatagatattcattaccctaaaactaaaatgtttcagttcctaaaaattgactacctaaattttacccaaaataactagttccattcctttggagggagccgtaactatcttta

SEQ ID NO: 89 - DNA, 112 bp, Artificial Sequence
  Affymetrix ID 2732012
ccttataagccaaagtgggtgaagatgaggtatggagcatggtatttgaaccccaagttgtggaaaaagcaaagagtagacgagcctctggttgaccctgaggtctcacata

SEQ ID NO: 90 - DNA, 25 bp, Artificial Sequence
  Affymetrix ID 2787588
ggttgctgcccttgagcattttgcc

SEQ ID NO: 91 - DNA, 25 bp, Artificial Sequence
  Affymetrix ID 3630110
atggagcacctgttcgtgtacctcc

SEQ ID NO: 92 - DNA, 81 bp, Artificial Sequence
  Affymetrix ID 3738711
gtagctaaacatatgcgtggggataaaaatcgggtggacaaggccagatacatgaagacatgctccactctcatctgtgaa

SEQ ID NO: 93 - DNA, 171 bp, Artificial Sequence
  Affymetrix ID 3675240
cccggactgatgtgatttctttgacaattacaaaaaacaaaaaacaaacaaacaaaaaaacgcaaagcaatagcagggaaaggacagtttgagaagacctgcaaggcctgccaggcggctcgcttgtgcagacacaaccgggacggctttgaggggacgtgcacacccaag

SEQ ID NO: 94 - DNA, 27 bp, Artificial Sequence
  Affymetrix ID 3458922
gggacctgagaaagaccctcatcctgg

SEQ ID NO: 95 - DNA, 51 bp, Artificial Sequence
  Affymetrix ID 2694337
gaggaagacttgtgcgcccggcccacacgaaccatagagccgatctccggg

SEQ ID NO: 96 - DNA, 106 bp, Artificial Sequence
  Affymetrix ID 2990414
ccctccacacgtgttcagttaaagtgtgaggaataccctccccagacaaacatcacagatttccgaaatcaaacacgctccagcaagtgttctgcacaccccactg

SEQ ID NO: 97 - DNA, 126 bp, Artificial Sequence
  Affymetrix ID 3190328
cttctcagttgggtcaagtccattgacctttctgttacagcttgagttttgtgtcttacgtagaaaaggtgcccctgctctcactttctgcacagctatcaggtccagctcatagcagttcttcta

SEQ ID NO: 98 - DNA, 65 bp, Artificial Sequence
  Affymetrix ID 3745435
ctgagattgcaggatctggtggataaactgcaagtgaaagtcaagtcctacaagaggcaggcgga

SEQ ID NO: 99 - DNA, 99 bp, Artificial Sequence
  Affymetrix ID 3110076
gtaaaagcgcggcaccgacaccagctgtgtgcagcagtggcggcggcggccgaaggagaaatagaacagcgcaggcaaaagaagaaaggcgcgggctgg

SEQ ID NO: 100 - DNA, 123 bp, Artificial Sequence
  Affymetrix ID 3471539
cacgggtccgctagctttaagtacaacaggatttccgtgttcaaaagactatactaagtgcttaatcaaatcccgtcacactaaagccaaatttagttctctaggaatcggagtctgcgtata

SEQ ID NO: 101 - DNA, 967 bp, Artificial Sequence
  Affymetrix ID 3918710
cagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatc

SEQ ID NO: 102 - DNA, 130 bp, Artificial Sequence
  Affymetrix ID 2792431
tccttggatatcacccagagtattgaagacgacccacttctggatgcccagcttctcccacaccactcattacaagctcactttagaccccgattccatcctcttcctacagtcatcatagtgaatcttc

SEQ ID NO: 103 - DNA, 90 bp, Artificial Sequence
  Affymetrix ID 3828963
gaagtggagcgagaaatctcattcagaacagagtgtggcctgtattactcctactacaagcagatgctgcaggctccaaccctcgtgcaa

SEQ ID NO: 104 - DNA, 85 bp, Artificial Sequence
  Affymetrix ID 3874927
gttcattgtccccatatcttgtgtgatctgtaatgacatcatggcctatatgtttggctttttctttggtcggaccccactcatc

SEQ ID NO: 105 - DNA, 65 bp, Artificial Sequence
  Affymetrix ID 3012468
ctggggtcagggaatttatcttacacacagtcagggatttgacatagcatcagaaggccgaggag

SEQ ID NO: 106 - DNA, 84 bp, Artificial Sequence
  Affymetrix ID 3541309
gatgtcatccggaaacctcaaggccaagtggatctgaactcccgctgccaaattgttcgaggggagggttcacagacgtttcag

SEQ ID NO: 107 - DNA, 46 bp, Artificial Sequence
  Affymetrix ID 3543492
gcaagtgacaacagcctttgcggtccttagacagcttggcctggag

SEQ ID NO: 108 - DNA, 30 bp, Artificial Sequence
  Affymetrix ID 3878896
aacgtgctcagggagaatcagctggtttct

SEQ ID NO: 109 - DNA, 241 bp, Artificial Sequence
  Affymetrix ID 2669445
atggctaaaactccaatagacagcatgtagtgcttgggtgacagactttgggacaatcacagccactacaaagtgaaaggggagaatccagaaagtacagagccagaaagggagagccccaaattctatgtaaaaactgcccaaatctttggctgaccactgaactatgcatgcatggggcagacgctaagcaacctagctaaggataaaataactaagccgagaattgaggtagtgcctc

SEQ ID NO: 110 - DNA, 92 bp, Artificial Sequence
  Affymetrix ID 3953763
gagcaacctggacataactgtcggctctcggcaacaagccacccaaggctggatcaacacataccccctgtccagcggcatgtccaccatct

SEQ ID NO: 111 - DNA, 398 bp, Artificial Sequence
  Affymetrix ID 3529048
gcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactga

SEQ ID NO: 112 - DNA, 67 bp, Artificial Sequence
  Affymetrix ID 3691111
ttgacgtggcttatcaacctttgtctcttacgtgctctttgttccggccatcgtcttgtttaacaaa

SEQ ID NO: 113 - DNA, 313 bp, Artificial Sequence
  Affymetrix ID 3845902
gggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaatt

SEQ ID NO: 114 - DNA, 62 bp, Artificial Sequence
  Affymetrix ID 4009521
gaccctgctttgaaatctcgacccaagaaaaagaagaattcagatgatgctccatggagtcc

SEQ ID NO: 115 - DNA, 1298 bp, Artificial Sequence
  Affymetrix ID 3817782
catgcccggcccagtaattaggtttttttttaaaaagccccaaaccttaattttatttgcccctcatttcacggagctcccagcgtagtggggagaagctggcccagagaaccccacgtcctgcacagtgagggccagcccttggggaccccatgtcctgcacggcgggggccaggccctggggccacgtgtgttccccccccacccctattttctgccgcgtgctcgttctgctgcacgtggctgtcacttgaatgggaatttaaaaatataacttaatgcacactgacttcccttgattggtgcaattaattatttgaaaagaaaaatatcacagtgttcttaaggactggcatttttccaagctgtgtcagttttgattgatgtctgacgccgtggctggcttctgaaagcctcaccagttctgatggcttattggcgacttcagtgtatccagcaatctctgctcatctttctgggggaatatataatgatcagcaggcctgagaactcctacaaatcagagataagaaaacaaatggcccgatgaattcggcgtgaggggcttgagcagacgcgttacgaaggagctgcaggaacgaaagccatggttcagtgcccagcatcggtagaagtcagaggcagccagctgggagacaccgccagccccaggacggccacgtcagaacaccgccaccagatgccagtgaggagggcgcagctgcacgctgctcccagccggggtggatgcagggcggtgccatggccatggaaaaccgttcggcattttcttggaaacggaagcatgtaccctgtgccccagcgatgccactctgtgcatatttactcaggagaaatgaaaacatatgtctccagaaagattggtacataagtgttcttagcagttttcttcacgagagccccaaactggaaacagcccgcacgtccatcaacaggaggatagataaataaataaccatagatccacgcgcaaccgagtactgtttagaaatgaaaaggagcggtcgcctggtgcacaggacagtgggaacaaatctcagaaacgcacgccaggtggaagacaacaggcacgtgtccctgccgtacaacgccattcatgtgaaccactaggagggaacgaggtctgtggtgactgagagcgcgtgcgtggttcggtggggatggcctggtagagggctggtaggaggggtgcctgggggcccggcatgttttgttcctgtctggatcagtggttacgcccagaactccgagcagcctgtgatccctgcgttttactg

SEQ ID NO: 116 - DNA, 98 bp, Artificial Sequence
  Affymetrix ID 3948736
cgttgatcccacctccttgatctggtttctaagacctcatacaaactgggcccgttagtctttgctccctgatactatctgataccatctggtctcac

SEQ ID NO: 117 - DNA, 102 bp, Artificial Sequence
  Affymetrix ID 3104724
ctggtcggacggaaacgctccgccggctttattgtcgcttcgttatgtggcggagccgagcagtttagcgtgcctctcaccctcagcgcctgcgaagccggc

SEQ ID NO: 118 - DNA, 116 bp, Artificial Sequence
  Affymetrix ID 3364565
actggcctgtgctacttattaccgggcttgtaatagcggttcttgtctccatagcctgttgagtgttcccagatgtgactcacctttctgctgccctcttcatgcaggcctactga

SEQ ID NO: 119 - DNA, 35 bp, Artificial Sequence
  Affymetrix ID 3540221
atgaggccggaaagatggcgaatttgcagggctgg

SEQ ID NO: 120 - DNA, 277 bp, Artificial Sequence
  Affymetrix ID 3458075
ccaaattttagttgtgaggaaacagacataccaagtattctttttagcaatgagcattagttctgtttttcttaacagtgaggcaaactatgtatatttacattttgtagaatatttcctccaaaattggtttctgcatactttttgtttttgctatcactgtttgggcttagagtagtatccttgaggctcgtctcatcttttttatttgttttgtttttttgtttgtttggttttgttctttgagactgctgcagtacaatggagcgatcccggc

SEQ ID NO: 121 - DNA, 313 bp, Artificial Sequence
  Affymetrix ID 3773290
caggctcatcattccttgttggatttcttcctggacttatttaaaagttgttatagctattatgaatgagcttttttaaaaattgtaattcctaactatattactggtgtagaagaaaactacagagctggtatccagctactttattgatttcttactgtttctattggcttttatttttcattagtagaggttgagaatttcagtatttcattcccagatccatatctcatttctttctcttgttttctttgcgttgctggagcctccaaaacagtctggggtaactgctatgctagcaggcctcctcatc

SEQ ID NO: 122 - DNA, 1081 bp, Artificial Sequence
  Affymetrix ID 2835195
ttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatg

SEQ ID NO: 123 - DNA, 152 bp, Artificial Sequence
  Affymetrix ID 2988321
aggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaa

SEQ ID NO: 124 - DNA, 92 bp, Artificial Sequence
  Affymetrix ID 3632941
cccagcaagttgcagaggctactgcccttgggaggcactcatgaaggtgcctccatctctcccttccccaatatacctgatggtcaactctc

SEQ ID NO: 125 - DNA, 1843 bp, Artificial Sequence
  Affymetrix ID 3855574
ggcagcaggggtcagattttcctcatggcctctccagcaggccagcccgggtttctcctggtggctgggagccaggagagcggctcccatgcagagtgctggtttcacatttgtgggtggcccatccgttgaggccagtcacgtggccaggcccaggaccagatgggagaggaccgcacaagtgcagcgtgagctgtgggaggtgtggctgaccacgcttagagagtgtggtgccaggaaagatctgatgtgtcaccattctatatctgtgatgggcagacgcaggcaggtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagcaagcatttactgagtacctctggcagttgatgcatacttcctgagtacctgttcatagcaggcttagctctggatgtggggtggtgaggaatcccacaggctgaggggtggcctgggagctttccagggggcctgaagcaggaggggctgcctgagtgggtcagcagcccagcccagtgccctacgcagccctgcccacacccccaacccagcctctgtctccccagtcccatcccccacaccctggtccctcctactttgtgcctcgaggacactgccccgctgccctcctcacttcccagcgtctgctgtcccctccgctgctgctgcccggcaggattgctctgtgtctcatccacgtttgtccctgcagagttcctcgcctctccctggaaccgccagcctcatgccgcatctcagaggctttttttttctctcttttttttttttttgagatggagtctcactctgtcacccaggctagagtgcggtggtgcgatctcggttcagtgtaacctctgcctgtcaggttcaagcgattatcccgcttcagcctcccgagtaggtgggactacaggtgcctgccacctcgcccggctaatttttgtatttttagtagagatggaatttcagcatgttggtcagtcaggtctcgaactcccgacctcaggtgatctgcccgcctcggcctcccaaagtcctgggattataggcatgagccactgcgcccggcctcagaggctttcattcccacttttcccccaaaactgcgcctctttggggtcatcagtgaccttcgcagggtcaagtcatccccctctcctgtcccaggaccttaagcactgccctgttttacagaagaggaaactgaggccccgagaggtaaggcagccagctcagggtcatcgcccacgcccagaaatgccaggattcccacccggacctctgaccaccaagctccaccttagtctggcccggggtcatccctcaggtgctgcctcatgccttgggtctgtctctcagaccaccctggcccttgcccctgctccccagcctgactgaagctgggccaggcagagactgaagactgaacgagtgtggccagcattcctcctgcacctgcccggagcctccaggcccagccgtccatgttcccagaagtccagaagtggctttgctgctcctggactctcactggccccccatcgacccttggaccaataactgccatcaaaataatcctgattatgcacctatcaagtccctggccctgggctaaagtcttcacaggggtcatctcatttcatc

SEQ ID NO: 126 - DNA, 194 bp, Artificial Sequence
  Affymetrix ID 2648215
tttcgcagttgccaaaaatggtgccgtaaggctttcctggaattaagtagtcagttggtatttggttagcagatgctttgtaaaacctaatatattcccactatatttcctttaaaaatcaagggggggttaacacctttagattgtcatgttttattgagaaaaatccacttctctgaaactccctattactg

SEQ ID NO: 127 - DNA, 360 bp, Artificial Sequence
  Affymetrix ID 2714009
atctgaggccaaggataaattcatcaactgggtagccaccactatagaagaagccaaccacaatcaatgtcggctatgcgtccagctgccagaggccgccaggaatgagctaccttgaagaatcgtccgtgacaacatttctgaatggctatgtcactatcaatggggccacaacaacaacacttgcaatccaacctgaacttcctatgaccaaaccaagcaatctatttatgcccaagtcaagtgaaaggtgaactccaccttcaccatgcatcaaaagccttggtatcctgcccaatatgcctggaacggtatatattgggaacctgctgtgctggtggccggattccatatagctcc

SEQ ID NO: 128 - DNA, 26 bp, Artificial Sequence
  Affymetrix ID 3342827
gagcaggcagttggcaaaccggaaag

SEQ ID NO: 129 - DNA, 36 bp, Artificial Sequence
  Affymetrix ID 3494235
ggaaagaagccgcaggatcagcttgttattgagaga

SEQ ID NO: 130 - DNA, 33 bp, Artificial Sequence
  Affymetrix ID 3816344
ggagctacctggcacatacgcaggggaagaagc

SEQ ID NO: 131 - DNA, 91 bp, Artificial Sequence
  Affymetrix ID 2340361
cggcggcttcgcctcgcccggcgaagcttctctccggtggccgctccttcttttccctcctctttgcgtcatgtcgggcacttaatttttt

SEQ ID NO: 132 - DNA, 182 bp, Artificial Sequence
  Affymetrix ID 3557286
agagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctg

SEQ ID NO: 133 - DNA, 26 bp, Artificial Sequence
  Affymetrix ID 3911399
attttcctgcattcacgatggcctcc

SEQ ID NO: 134 - DNA, 178 bp, Artificial Sequence
  Affymetrix ID 2612381
cagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaa

SEQ ID NO: 135 - DNA, 45 bp, Artificial Sequence
  Affymetrix ID 3354739
tttgagaggttatttgtccatgggatgctcgtgttaaaacaaaaa

SEQ ID NO: 136 - DNA, 141 bp, Artificial Sequence
  Affymetrix ID 3434425
taatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttc

SEQ ID NO: 137 - DNA, 58 bp, Artificial Sequence
  Affymetrix ID 3734620
aggaagcggagttttacaacatcgcgtcccttgtgcggctggttaaggaaaggatacg

SEQ ID NO: 138 - DNA, 326 bp, Artificial Sequence
  Affymetrix ID 3802333
ttcagctacgttgtcccagcacttcactggttaaccttttatgtccaccatttgtggatttcacagctacttgtcaatggtgaatattgatcatcatcattatctactgagctgctaccatatcccagctactccttgcatgttgttcattattttctcaacactcagcatatttgcaatatgttatgtaatatcacagacaaggaaactgaacgcagaaatgttttatttcttgccaaacatcacatgaggatgaacaatgaaaccgatttgaaaccaggattgtctgattccaacatctctgggtcctttttcactctgatatg

SEQ ID NO: 139 - DNA, 104 bp, Artificial Sequence
  Affymetrix ID 2896736
aggatctagctctcttgctcaagctggagtgcagtggtatgatcaaaactcactacagcctgcaactagtgatcctcctgcctcagctatagctaaaactatag

SEQ ID NO: 140 - DNA, 234 bp, Artificial Sequence
  Affymetrix ID 3053930
ttggcacactaactccacttctagacatctatcctaagataataatcaacatataaaaatgcacatacaaatattgactataagaataaaaaaatttcagcatttaagctgtacaggtgaatgtttaaattatggtacacccatttgtgttatttattttaaaaaatttttttgaagtataactatgtagaaaactgtcctagcataatgttaagcatcgttcccaatgtgttt

SEQ ID NO: 141 - DNA, 286 bp, Artificial Sequence
  Affymetrix ID 3459700
ctaaggtgagacaggtctgtgaatccggggtctctgtcacttggggaaaaaaaacgggcagaaaagctctgaagtttgaaacacataaggaaaatctgctatctgtacccccaccctcccaaaatatagttgacgcccccgcgtgatgaagagtttatgggggtggaggcttggaggagatgtcactgcgcctgggagcttgtgtccgattccgggaggtggccgtgtccgagtgcgtggttgtacatttccgaaggtctcagtttctctcactttcagcccgcga

SEQ ID NO: 142 - DNA, 26 bp, Artificial Sequence
  Affymetrix ID 3223562
gtctgccagttgcgatgccctcacag

SEQ ID NO: 143 - DNA, 112 bp, Artificial Sequence
  Affymetrix ID 3888086
ggaaaggccttgacatggcaagacggtgtagtgtgacgtccatggagtccacagtgtcctcggggacccagacaactgttcaggatgaccctgagcaatttgaggtcatcaa

SEQ ID NO: 144 - DNA, 27 bp, Artificial Sequence
  Affymetrix ID 3378887
ggattccagccgaacttccatccgcag

SEQ ID NO: 145 - DNA, 122 bp, Artificial Sequence
  Affymetrix ID 3280240
acctttccctgaggttggataggcactgctccccttctctgtgcccctggctcccacatctaatgttctcctggcacttacgacactctcattcaaattttctagccatgcaccttaagccc

SEQ ID NO: 146 - DNA, 35 bp, Artificial Sequence
  Affymetrix ID 3379391
ttttgtacatgcacttgcagtattgaggttaatca

SEQ ID NO: 147 - DNA, 68 bp, Artificial Sequence
  Affymetrix ID 2351210
gcagcacccacctcaaaagccaaaacagactcaatcaacatcctagcggacgtcttgcctgaggagat

SEQ ID NO: 148 - DNA, 130 bp, Artificial Sequence
  Affymetrix ID 3758440
gtttcactatcgagagtcggactgcttttggatttacgtggctttgtgggatgcggtatgaagatcgttgcattcaagtttaccgcctctacttcactgcagaatctgactgccgtcagatctgtatgac

SEQ ID NO: 149 - DNA, 90 bp, Artificial Sequence
  Affymetrix ID 2617213
tattgggctggaaccatcaaagtgctgaaccttacggacaacacctatttaaaactgaacgacgaagtgatcatgaacaggcggtacacc

SEQ ID NO: 150 - DNA, 94 bp, Artificial Sequence
  Affymetrix ID 3677835
aaccagaggagttacgccaggccctcatgccaaccctagaagcactgtatcgacaggacccagagtcattacctttccggcagcctgtagatcc

SEQ ID NO: 151 - DNA, 194 bp, Artificial Sequence
  Affymetrix ID 2332491
atccttctaagaggcgcaagttggctgcctttccagaatcctctgattttcgttgatccaaggggctggaactgagcttcctttttcatgccaagtagggtccaaacaacagagaaacataaagctcttcctttctccccaacctcaccagcccttaccatggctggcttcccagtgattcattcaaggcaaca

SEQ ID NO: 152 - DNA, 862 bp, Artificial Sequence
  Affymetrix ID 2932426
tggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaa

SEQ ID NO: 153 - DNA, 84 bp, Artificial Sequence
  Affymetrix ID 3273785
taaagtaagcatattgtcaaccttcctcgctcctttcaagcacctgagtcctggcatcacaaacacggaggatgacgacaccct

SEQ ID NO: 154 - DNA, 69 bp, Artificial Sequence
  Affymetrix ID 4015409
tgagaaggctttgaagcagtataactctacaggagattatagaagccatgcagtagacaagatccaaaa

SEQ ID NO: 155 - DNA, 63 bp, Artificial Sequence
  Affymetrix ID 2428715
ggccacagcgttcagttgatgtggttgtatcctcggttttcctactgacactttcgattgctt

SEQ ID NO: 156 - DNA, 31 bp, Artificial Sequence
  Affymetrix ID 3261500
gtctgccaaggtcccagagcgaaagttacag

SEQ ID NO: 157 - DNA, 89 bp, Artificial Sequence
  Affymetrix ID 3144008
cagacttttgactggcgttgagtacgttgttggaaggaaaaactgtgccattctgattgaaaatgatcagtcgatcagccgaaatcatg

SEQ ID NO: 158 - DNA, 64 bp, Artificial Sequence
  Affymetrix ID 3527425
atctgtgaaggccttgctgttaaagggcaaagctcctgtggacccagagtgtacagccaaggtg

SEQ ID NO: 159 - DNA, 75 bp, Artificial Sequence
  Affymetrix ID 3836942
taccaggagcccatggatggcgtgacccagcaggcagcacagaatgtacttgccaaggcgggcaaagagtaaacc

SEQ ID NO: 160 - DNA, 60 bp, Artificial Sequence
  Affymetrix ID 2746889
ggagtcaaacgtcagagcctgagacctttgatgaagggtcacatcgccagagctcagtgg

SEQ ID NO: 161 - DNA, 269 bp, Artificial Sequence
  Affymetrix ID 2853401
gctgagagctagctttgctttataattttgtacttactaaaaaattaaataacttataaatggaggaaaacttggatcagttgatagattttgggggagttagtgaaatttcttgaggggattttcaatcgaatgcttttattttctgtggcagtaatgatctggttggtttatctcataaataactgatgctgctgctttttgtgttctttgatgtctcaccttatgtttttactaagtaaggacagcaatggattggcttctgatgc

SEQ ID NO: 162 - DNA, 64 bp, Artificial Sequence
  Affymetrix ID 3593678
tgtcctgcgcaatgagcctttggttttagagggaggctatgaaaactggctcctttgttatccc

SEQ ID NO: 163 - DNA, 50 bp, Artificial Sequence
  Affymetrix ID 2466363
tgataattggtgacgacaaggaaattaagacgattgctcaaagagatgca

SEQ ID NO: 164 - DNA, 77 bp, Artificial Sequence
  Affymetrix ID 2961018
gatcttccacacaaagatcaggtgaagaaatctatgcagctatacatgctaggacctgttgtacaccatccctgcaa

SEQ ID NO: 165 - DNA, 157 bp, Artificial Sequence
  Affymetrix ID 3307825
ctgaggaatcttaaatctgggtataaacgtgaaatggttttattttttccttactgggtctccagtcatacagtgtaaaacactcctaacctctgtactttcctctgcagtgcagtcctttaagaatcccttggtccgatgtaactttgccgccact

SEQ ID NO: 166 - DNA, 36 bp, Artificial Sequence
  Affymetrix ID 3375666
gacccgcagggccagacgttcttcgccgagagtcgt

SEQ ID NO: 167 - DNA, 603 bp, Artificial Sequence
  Affymetrix ID 3510380
gcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttca

SEQ ID NO: 168 - DNA, 30 bp, Artificial Sequence
  Affymetrix ID 4026959
caagccagccaacaagcggcccatgtcctc

SEQ ID NO: 169 - DNA, 57 bp, Artificial Sequence
  Affymetrix ID 2888352
agagcagctcccgtcgtaccgctttaacccggacagccatcagtcggagcagacgct

SEQ ID NO: 170 - DNA, 26 bp, Artificial Sequence
  Affymetrix ID 3320634
gagaaattgagcgcaatacatgcaag

SEQ ID NO: 171 - DNA, 170 bp, Artificial Sequence
  Affymetrix ID 3752442
taggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctc

SEQ ID NO: 172 - DNA, 33 bp, Artificial Sequence
  Affymetrix ID 3188731
caggactgtgtcaaggagatcggcctcttgaag

SEQ ID NO: 173 - DNA, 223 bp, Artificial Sequence
  Affymetrix ID 3303115
ctggaccaaccactacttccgtgtttcaagttcatttttagcacatgaacatgatcactgttagccagtgaagtagcttctgactagatcattgattagatctcacaaaaaaccaaaaatagtatatggaaaccaagatgagagcaaaagaaaacgttacctgagtaggcagctaaaacatattttgacattatttttaagcagcattcataaggttcacgga

SEQ ID NO: 174 - DNA, 88 bp, Artificial Sequence
  Affymetrix ID 3820685
ggttctggcatttatgacccttgtgaaaaagaagccactgatgctattgggcatctagacagacagcaacgggaagatatcacacaga

SEQ ID NO: 175 - DNA, 143 bp, Artificial Sequence
  Affymetrix ID 3882554
ataatgggatggcaaatagtctccccagcccagagttcaatatcctcctggttgctggctgagcttagactagaattatgttgagtttccaggacacccattttacgaatgttattttgaattgcctgttgtatgtgataata

SEQ ID NO: 176 - DNA, 93 bp, Artificial Sequence
  Affymetrix ID 3054154
ctacacgctgccgaggaaaacgcaacagacatggcaggtgcctcacgacaagaaacacttacaaatagaatcaaaactgattcaagtcataca

SEQ ID NO: 177 - DNA, 129 bp, Artificial Sequence
  Affymetrix ID 2624472
atccgcgtaggctgccacaagctcatcaaccaccacatcttcaccaacctcatccttgtcttcatcatgctgagcagcgctgccctggccgcagaggaccccatccgcagccactccttccggaacacg

SEQ ID NO: 178 - DNA, 57 bp, Artificial Sequence
  Affymetrix ID 3652530
gactgctgtgtaagctatggtggcatgtggtaccttaaagggacagtacagtcttga

SEQ ID NO: 179 - DNA, 31 bp, Artificial Sequence
  Affymetrix ID 3980537
actaccacggagaacccatctctgtcaatgt

SEQ ID NO: 180 - DNA, 697 bp, Artificial Sequence
  Affymetrix ID 2808239
cacaggtgaattgtctgggaagtcaggatgttgcacagaagctatgcaagtcatagattagaaaagcaagaatccacattcatgctttccagcatagatgaggagatactttttctccaccttcttagattcagtggctgggcagagagtgctgtgaattcatctgacaacaggcagattaacacgagaaaaggaatataagttttttattttttatttttttatttttttgttttgagacagagtgtcactctgtctcccaggctggagtgcagtggctcactgcaagctcccacctcccgggttcacaccattctcctgcctcagcctcccaagtagctcagactacaggcgcccgccaccatgtccagctaattttttttattttttagcagagacagggtttcacctcccaaagtgctgggattacaggcattagccaccgcgcccagccaagttttttaatgtttaatctaatgtgcatggaggcatcatagaaagaactgaatatccaaaagtgtggtgaaatttgagactttagataccatcttaatgatagtggcaggaggcagacaaatcctagggagacaagggtgggtccctggtgaaaccccaccttcaaaccaaagacagtttaaagcatgaaagccaagctacaagtctccagtaaatccatggaccggattaagaatctctc

SEQ ID NO: 181 - DNA, 84 bp, Artificial Sequence
  Affymetrix ID 2811059
ccatcagcttgtgactcatggcttagctggtctcaatggggaacaaaccagagagtctatggatcaacacaaagctataactgc

SEQ ID NO: 182 - DNA, 96 bp, Artificial Sequence
  Affymetrix ID 2858392
ggcccagcttcatggatatacaaactatacattcacatgggttccacacctagatgggctcttacatcatgtagctggtcctacctgggagagagc

SEQ ID NO: 183 - DNA, 31 bp, Artificial Sequence
  Affymetrix ID 2779739
tctgttcacggagcttagttctacttcctga

SEQ ID NO: 184 - DNA, 97 bp, Artificial Sequence
  Affymetrix ID 3298972
gttaactataggtaggggacagagaaaggagcagagttaatgtatgctattgaagctgagttgctatcagtctgaactagactttgaactcagcatg

SEQ ID NO: 185 - DNA, 89 bp, Artificial Sequence
  Affymetrix ID 2933580
gaaactggccacgtgcgatgcggacggaggcatattcgtgtggattcagtacgagggcaggtggtctgtggagctggtcaacgaccgcg

SEQ ID NO: 186 - DNA, 31 bp, Artificial Sequence
  Affymetrix ID 3528128
caactaggccaaaccagtacagctactatcc

SEQ ID NO: 187 - DNA, 148 bp, Artificial Sequence
  Affymetrix ID 3528025
cggcgctacgttaacttcgactatattaatgagcatcacgatcttcattttcatgatcccgtagtcctcgcggtcgtagaaaatgaaaggaaagcagccgttaacacaggaagagcgaaaaaaggacattttccctggcgatcgtggc

SEQ ID NO: 188 - DNA, 158 bp, Artificial Sequence
  Affymetrix ID 3581134
gatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgttttttta

SEQ ID NO: 189 - DNA, 58 bp, Artificial Sequence
  Affymetrix ID 3676391
tgggccatctcctcggtacaggtcagctgccgccggcggagctcctcatctgtctcct

SEQ ID NO: 190 - DNA, 163 bp, Artificial Sequence
  Affymetrix ID 2319003
ccaagagcccggaattttcattacaactttcaaagagagcaagaggaggagggaaaaagatttcacaaaagcattatcaaggccccaacccaggatgccctgctgtacaaccaaaatttgtaagaggtcagcctttcagggagtcaaaaacccagcatgtgga

SEQ ID NO: 191 - DNA, 82 bp, Artificial Sequence
  Affymetrix ID 2858313
ctgcagagcaaaatatagaggcactaattttgttatatttgcagcccacatactgtaataccagatttgctcctgttgttct

SEQ ID NO: 192 - DNA, 325 bp, Artificial Sequence
  Affymetrix ID 3048750
cgggaaacttcggaagacagctgtgcctggctctgtggctgcatgcagtgcttcacttggccagcagaggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttga

SEQ ID NO: 193 - DNA, 25 bp, Artificial Sequence
  Affymetrix ID 3360848
tgaggaggggacgttgaccttccca

SEQ ID NO: 194 - DNA, 58 bp, Artificial Sequence
  Affymetrix ID 3387192
gccaagagtggtaatggcgtctgtatgatcttcggagcctgctgcatcggacctcggc

SEQ ID NO: 195 - DNA, 133 bp, Artificial Sequence
  Affymetrix ID 3893880
actccgcagggctggcacttcctgagggagtgggggctcaggcttcagacggactttattaaaatgtgtagtttgtgtgaatcatttcagtcaaaagtttcagctatactcggccgttaagacaacttaatga

SEQ ID NO: 196 - DNA, 26 bp, Artificial Sequence
  Affymetrix ID 2393792
ggaagggctgccatagttgccgcagt

SEQ ID NO: 197 - DNA, 747 bp, Artificial Sequence
  Affymetrix ID 2395248
tcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttc

SEQ ID NO: 198 - DNA, 25 bp, Artificial Sequence
  Affymetrix ID 3403226
ctcacccttgaggcccgggcacttc

SEQ ID NO: 199 - DNA, 120 bp, Artificial Sequence
  Affymetrix ID 3920956
cccaaatgtgagttgcatcaaattcggtaaatgtagagtatgtttgttttctctgtacacaatactgacgtcagtgctagtgcctgcctaaactcagacaccagtagatccttttccaga

SEQ ID NO: 200 - DNA, 52 bp, Artificial Sequence
  Affymetrix ID 3970256
tttgaaaagtactatcaatgaagccttaccaaaggacgtgtctgaggatcca

SEQ ID NO: 201 - DNA, 136 bp, Artificial Sequence
  Affymetrix ID 2724115
gcaggccttacttatttccacaggaccttataagctcatacactctattgcttattacgttactggaatctatctaagcagaaagaggctggcccaccttctgttatctatgtttctatactctttggacttgcta

SEQ ID NO: 202 - DNA, 51 bp, Artificial Sequence
  Affymetrix ID 3351955
caaccacatgcgctttcgtcacagtgaggaccggccctttaaatgtgactg

SEQ ID NO: 203 - DNA, 174 bp, Artificial Sequence
  Affymetrix ID 3133234
ggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgt

SEQ ID NO: 204 - DNA, 30 bp, Artificial Sequence
  Affymetrix ID 2723089
tttgtggctgttaataggaaggatgctggt

SEQ ID NO: 205 - DNA, 209 bp, Artificial Sequence
  Affymetrix ID 3102652
tgtggcaaactaccacggcagatgtttacctatgtaacaaaactgtacatcctgcatgtgtacccctgaacttaaaaagttgaaaaaaaaaaaaaaagaaacaaataggctgggcatggtggctcaatgcctgtaatcccagcactttgggaggccaaggtgggaggattgcttgaggtcaggagttcaagacctgatatagtgagacc

SEQ ID NO: 206 - DNA, 244 bp, Artificial Sequence
  Affymetrix ID 3392531
ttggacttgaatgactaggagaatgactactctaatgaacaaaaatgtaaatgttatatgtgggtttagtaagggaatgcaatgaacttggttttggatatgttaaacttgagttatcactggaacattcaggtagaaatgtttagaaagcagtttgaaataagagtttagtagaaaggttgagagcagcgctgcagatacagatttgaaagtcatctgcaaagagatgtgtcttagcgttctc

SEQ ID NO: 207 - DNA, 31 bp, Artificial Sequence
  Affymetrix ID 4015009
tggaggcggccctacacctggcaatggaggt

SEQ ID NO: 208 - DNA, 113 bp, Artificial Sequence
  Affymetrix ID 2596170
gatgagttgccggatgacattgccaatgagatcactgacattccacatgacttggaattgaaccaggaggacttttcagatgtcctgccacggctacctgatgacttacaaga

SEQ ID NO: 209 - DNA, 66 bp, Artificial Sequence
  Affymetrix ID 3591676
aaaacctggaatgctgtaggacatgtacccactgaggcggatgcaaggagcgatggagaggaagga

SEQ ID NO: 210 - DNA, 25 bp, Artificial Sequence
  Affymetrix ID 3680412
tttaccccttctcggtgacatttgc

SEQ ID NO: 211 - DNA, 533 bp, Artificial Sequence
  Affymetrix ID 3906169
ctgcttgacttactgggtgatattgggctacaactgagactcactttgctcctgtgtaaagtggggcaacagcatctaccacggagggttgaagatttacggagatcatgctaagacagtttgttccaaactcaaaggaaatcatttgcaaacaacagaaaaggtcagaaaccgtatacctggccaagagagatcccttttacgctttgtttaatgtttcatgttgtattttgggttttcccatttactggattctgagctccaaaacaggaatcacattttatgttttcttattttaaaagcaataataataactagtacttattgagtgcctactgcttaccatgttcaaggctttacatgattatcttgtttgttcctcacaaccactctgaagatgggctttgttattcccattttataggtgaggaaaataaggctttaaagcattaaataatttccccaagattatccagctagtaagtgacaaagcaggaaaccaaaccaaggacctttttctctaggggctgaga

SEQ ID NO: 212 - DNA, 1003 bp, Artificial Sequence
  Affymetrix ID 2803102
ctatatgtagctaccctgtggcctccccctaaggtaaccactttactttttagtagtgaagaatgtctaaaatataataaaggtatatctagaacacaaacctccaagcaggaacaacccattatctctcctttgcatgccctgtcaatggcttcaaggtcaaagctagctaagtctctgagtgtgtagggagctgacatcttggtgaaaagtccttcagtacatgctagatcatagctgacttgcactatccttccaaactttggaatatctctctggtattggattggttacaatggaaacagaaagattctgatcatacaaaataaagattttcatttgtgagctcaaccattggatctgtcatcttccattagtagaaaaaatgaggaaatcaaatactttgttttgtttttaaccacgcagagaaggaagagagtagagtgtgggaaattgatatatctgccttactgccccagcccctccctctggagtgtgcaagtggtcagaagtcagcaaattacttttccatcatatttggccccaaactaccctggtgagtgaggagaaagggaatcatttgataaggtttggaaaatagcatctgtttttcttagtgtttctggatgaatttatcaggcatccggtaatttgtactttctgttgaaaactataatagaataccgtgcatagacatgaaaccttttggtattagtcagaagctacatactgactgctgttggagaagaccacatttacagtcaagggtagaatcatctgaaatagtttcccctggaaaaaaaaaaaacatggccatatatgcctacatagatctcctctttgcttcatgaatttggaactaaacctgggtgtttagataattccagttctaggattttctcaccttgagtttattccccttattcttactagttcagtttggccactgtacatatggagcttactagaggcaaagcactctgtgaggggcaatggttataca

SEQ ID NO: 213 - DNA, 206 bp, Artificial Sequence
  Affymetrix ID 4025793
ttgtgtctgctccaagtgcgaaccctccatgcactgcagagaacaccagaaggagaggagcactacctgagcttctccttccgggtctaaaggtggaacttgctttgcagcacccagcatttcactgtactgattcctttttttggatcaccacctcctgcgtttagcagcccatatgctgggctcactcagctatacactgcttg

SEQ ID NO: 214 - DNA, 55 bp, Artificial Sequence
  Affymetrix ID 2616236
aattttggaggctgcccgatgctcccatttgactgacgcaggttttacactttta

SEQ ID NO: 215 - DNA, 305 bp, Artificial Sequence
  Affymetrix ID 2959832
tccggtgcttacctctaactgataaaactagctccaacccaccaccctccactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatgga

SEQ ID NO: 216 - DNA, 105 bp, Artificial Sequence
  Affymetrix ID 3072195
ttagtgtcgtcaggagactccctccatcagaattactcaggctgattgttttgagtcctgggacccagttggtatccagaatcttggcttgtttgcctaggaacc

SEQ ID NO: 217 - DNA, 108 bp, Artificial Sequence
  Affymetrix ID 3757471
gggtgtcaacgagctggcaaactatggggagtactcaggcgcccccagcgagcagcagacctatgactatgccaagactatcctctccctcatgacccgagagaagca

SEQ ID NO: 218 - DNA, 71 bp, Artificial Sequence
  Affymetrix ID 3986531
gagggaggaattacgtggtgaaggatgaagtgaacagcggtgcttggcatataagccagccctcaaacaag

SEQ ID NO: 219 - DNA, 1201 bp, Artificial Sequence
  Affymetrix ID 2696767
cttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggcca

SEQ ID NO: 220 - DNA, 236 bp, Artificial Sequence
  Affymetrix ID 3188391
caggggtacacccacatctattgtattagacaaatcacagagggattgcaacagaacacagatttttctcactgttttttctctggttgatcgggatgcattatccaccagaaaacactgtagacgactcactcaccaggaaaagagcatatgccagttggaataaataaaggggaagagtaaggaagaggctgtagaattattttataaattatcaagtcttatgagccaggtgc

SEQ ID NO: 221 - DNA, 218 bp, Artificial Sequence
  Affymetrix ID 3846196
tctggccaatgcatattacttaagggcaatgtcgtggccagctgtggtggtctgggctctccctctgtatcgcctggggaggctgctgaggtgactttttggaagaaaacacgggatgagtgtatgatggtggctgtggagaccacccaaaatcccggggttgggggcaatagtgaatgaatgggaccatctgcgtgggtccctacacgagatgcttg

SEQ ID NO: 222 - DNA, 28 bp, Artificial Sequence
  Affymetrix ID 3070747
gagctcattctgcgtttcttattgcttg

SEQ ID NO: 223 - DNA, 84 bp, Artificial Sequence
  Affymetrix ID 3821522
gtagataaccatttgtcgctgctttttctgttaagtgttcaccacttgtatcattggctggcaatacctggtttgtcatagttt

SEQ ID NO: 224 - DNA, 25 bp, Artificial Sequence
  Affymetrix ID 3875001
agctcctccccagaataccatgctc

SEQ ID NO: 225 - DNA, 66 bp, Artificial Sequence
  Affymetrix ID 3279450
ccaaagtttaattaatctcctgctgacgggacatgctgtttctaatgtatgggatggtgatagaga

SEQ ID NO: 226 - DNA, 32 bp, Artificial Sequence
  Affymetrix ID 3541293
tctttctctggcctggtctacaagaatgtcac

SEQ ID NO: 227 - DNA, 52 bp, Artificial Sequence
  Affymetrix ID 3547709
cctggaacgtctttgaaactccctggaactaatcagacaggagggcctagcc

SEQ ID NO: 228 - DNA, 283 bp, Artificial Sequence
  Affymetrix ID 3875261
gccaaccttggtttgtgcagtttaaggaaaaaagccatctccataacatggaagtgcaagatgaagcagcaggcactagtggggaagctgcagcaagttatacagaaaatctagctaatgatgagggtggctacactaaaaacagattttcaatggagacaaaacacccttctattggaagaagatgccctctaaagctttcataggtagagagaggtcagtgcatgggcttgaaagaacaggctgattctcttgctagaggccaatgaagccagtgagttta

SEQ ID NO: 229 - DNA, 163 bp, Artificial Sequence
  Affymetrix ID 2584791
cactggaagaatataggttggctcagacagtccataggaaggctaaataaccacgctcaggaaatgggccttagagagtgggaagagaaaatgtatctaaacttatatctcagtaacagcttgataggacattgtcactagcagtgccaccactaggtcctca

SEQ ID NO: 230 - DNA, 46 bp, Artificial Sequence
  Affymetrix ID 3204563
ttgccagcactctgaacccatgcgggctaatgacctgcccatcctg

SEQ ID NO: 231 - DNA, 65 bp, Artificial Sequence
  Affymetrix ID 3356165
cgagactctggatgttaaggaaatgattttcaatgccgagagagttggaggcctcgaggaagagc

SEQ ID NO: 232 - DNA, 298 bp, Artificial Sequence
  Affymetrix ID 3650891
tacactccctcagggacagtcttgccatttcccgtttttcattcttataaacaatgccctggtgcaggggtcagcaaacttttctataaggagtcagataatcttttttttttttttgtattcccttttggcaatttgtttaattgagataaaattcacataacttaaaactcacccttttggtgtatacgattcagtgctttttagtatattttcaagattgtgcaaccaacaccactatctaattccagaacatttttatcaccccaaaaaggagccctgtgccaattagctatca

SEQ ID NO: 233 - DNA, 56 bp, Artificial Sequence
  Affymetrix ID 3829699
actgaagcccttaagccatactcttcaggaggtccccgcgtctggtatgtctccaa

SEQ ID NO: 234 - DNA, 94 bp, Artificial Sequence
  Affymetrix ID 3971251
cctcttatacctagaagtcccacaagcagcgttgccacgccttccagcaccatcagtacacccaccaaaagagacagttctgccctccaggatc

SEQ ID NO: 235 - DNA, 58 bp, Artificial Sequence
  Affymetrix ID 2359255
agttgtggaggcatgtttataagcagatctgagttttgccacactggaatttatttat

SEQ ID NO: 236 - DNA, 64 bp, Artificial Sequence
  Affymetrix ID 2811000
ctgggtctaggaagccaggtactttgtgctgtttcaacaagagctcttctgctttaactagttt

SEQ ID NO: 237 - DNA, 92 bp, Artificial Sequence
  Affymetrix ID 3391986
gctggagaagttcgtctgggacaaagagctctggcctcatgcctgtgggtccagcagtcaaactgggacagactatgtgaaaagggacccac

SEQ ID NO: 238 - DNA, 174 bp, Artificial Sequence
  Affymetrix ID 3888361
agcagcctcccgcttagcggagagtgggatgagcacatgcgcggccgacagggaagagtgaatccagagcagaagtcaagggcaagactcgtgggggggggaagaaagggacagaagccagctcccagcaataaaggtcgggttattttgttcttttgtgacatgccctatatc

SEQ ID NO: 239 - DNA, 327 bp, Artificial Sequence
  Affymetrix ID 3897502
tctcctggggacttacatagctgtttggtttttcaacttgattgaagaaagttattcgggggatctgtccaattcacaccttctgttccctgatcaaatactttagggtcaaacataaggttttattgatttttgctcaagcaaagaattaacatttttgataaggaactgtaatggcaattataaggtaatatggtgtatggtaatattatgctgccagaggaaacatttgactatgattaaattcaagcccagtactgggtagctctagataattaaagataattttatccattcaagtcccctctgttaagctgcacattgaca

SEQ ID NO: 240 - DNA, 70 bp, Artificial Sequence
  Affymetrix ID 3235381
acagtatattgtgagcatggtcataaagctgccaaaatcaaccccctcttcaccggacaagccctgctgg

SEQ ID NO: 241 - DNA, 118 bp, Artificial Sequence
  Affymetrix ID 3286657
tccagtgaggccacatcatgacttcccccatgaagacatcgaattcacggctgccttcacctttgtcctgtcaatgtctgatctttcctttcaattacagcacgaggctggggttcca

SEQ ID NO: 242 - DNA, 90 bp, Artificial Sequence
  Affymetrix ID 2714224
tggaccagatgttccagttcgcctccatcgatgtggcgggcaacctggactacaaggcgctcagctacgtgatcacccacggggaggaga

SEQ ID NO: 243 - DNA, 89 bp, Artificial Sequence
  Affymetrix ID 3331851
tgaaagtagagcattcgagagcactcctcttggttacggaagatattctgaagctcaatgcctccagtaaaagcaagcttggaagctgg

SEQ ID NO: 244 - DNA, 373 bp, Artificial Sequence
  Affymetrix ID 3356559
gccatggttctcttgtggtcagctcttgttctaatccttagcgcccatttggaaaccagttatggggaaagcacaatgtaggactcttgggactctgcacctgactggctggctttccaagatcactgagatggctcttcctccagcatagaaattgatggctggttatccagacagcaacctcttttgcccatgtgcttggtgctctgtcatggcgggaaaagtaactatgcacagatcatgattatggtattagattgggtacacatgaaattgctagtatgcacctattttgatgtatgaaaatatcattttcatgagattcatcctaatttatgctatgtatggggcctgattgccctaacagctcatc

SEQ ID NO: 245 - DNA, 70 bp, Artificial Sequence
  Affymetrix ID 3636325
atcagacaccgcctattcaccagctcatctataaaaccccctgcatttcaccgcagaactggaacctatt

SEQ ID NO: 246 - DNA, 344 bp, Artificial Sequence
  Affymetrix ID 2539613
tccattcttgcgcttaaaaactgtacctaactccctcccatagcagacagaataggataggcttcttccctacctggtgttcaagttctaccactgccctcctcccttcccccatttacctctctagaattaccaggtatctatgcatacatgaattctctgcttccattagatttacttgtcattccccaaatacaccatgcacttgcatattagcaaagccaagtttgtctttcacaaatgcagaggttaaataagagttaaggatgaaggtaaaccaaactttatttatatactatattttaccaaatatgatttaaggatctctaggcagtgttgtctta

SEQ ID NO: 247 - DNA, 86 bp, Artificial Sequence
  Affymetrix ID 2860647
gcaatgtggaccagaccatcgacaacccctatgccacctttgtcaagatgctaccggataaggattgcctctacgccctctatgac

SEQ ID NO: 248 - DNA, 44 bp, Artificial Sequence
  Affymetrix ID 3143676
cccgatgcggtgtacctgaccagacaagaggtagctccaaattt

SEQ ID NO: 249 - DNA, 27 bp, Artificial Sequence
  Affymetrix ID 3492475
tgggctgaccacagactttaccacaaa

SEQ ID NO: 250 - DNA, 32 bp, Artificial Sequence
  Affymetrix ID 3698355
gtccgagcctccgtactgggtgcaatgaaagc

SEQ ID NO: 251 - DNA, 136 bp, Artificial Sequence
  Affymetrix ID 3364564
attggcgtggttcttccccaggataccttatagagtctagtgaacttttcctgtttgtggaaacaatcaggctgggtttaaatgaggacttgtctctatttggagcatttgtgagcgtgtaaggaaatgagtgttt

SEQ ID NO: 252 - DNA, 165 bp, Artificial Sequence
  Affymetrix ID 3101645
agggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattg

SEQ ID NO: 253 - DNA, 118 bp, Artificial Sequence
  Affymetrix ID 3015159
agttcatggacctgagatgctcgcaagggggatggtgcctctggatccagttcaggagtcctcgagctttgaccttcatcacgaggccacccagtcccacttcaaacattcgtctcgg

SEQ ID NO: 254 - DNA, 79 bp, Artificial Sequence
  Affymetrix ID 2686624
atacctttcaagctgcatggccctcagcagatgaatccatcaccagcagtattccaccacttgatttcagctctggtcc

SEQ ID NO: 255 - DNA, 332 bp, Artificial Sequence
  Affymetrix ID 2897644
atgttgggtcccaccttacatttagtttcatgtccccttagtttcctccaatctgtgacagtttcttaattttttcttgtcttctgtgaccttgacacttctgaagaaaacatttccttgatatttctgatgaaaatgattattatgtagaatgtccttcaacttgaattggtctttttctcatgattagaatgaggttctgggtttttggcaagcagagaacagaagcgatactatatttttctcagtgcgtcatatcggggtcatgatgtcagtgtgtcttatactggtacactaacccatgtctgctaggtttctttccaatacagtca

SEQ ID NO: 256 - DNA, 29 bp, Artificial Sequence
  Affymetrix ID 3909740
ggtggagcaagagccctgttggctgatgg

SEQ ID NO: 257 - DNA, 39 bp, Artificial Sequence
  Affymetrix ID 4049026
ggcacagaagggcaaattccgcacattctcatttgtggg

SEQ ID NO: 258 - DNA, 33 bp, Artificial Sequence
  Affymetrix ID 2321582
atggagccagaaaaacgcgtgcagcagctcatc

SEQ ID NO: 259 - DNA, 66 bp, Artificial Sequence
  Affymetrix ID 3304498
ggcttgctctcaattttgcgcaagttgaaaagtgcaccagaccaggaggtgagaatacttctcctg

SEQ ID NO: 260 - DNA, 26 bp, Artificial Sequence
  Affymetrix ID 3533002
tactgaatgtgcttggttttggacag

SEQ ID NO: 261 - DNA, 33 bp, Artificial Sequence
  Affymetrix ID 3568039
ctcttgctgccgctgcagatccagtcttcctcc

SEQ ID NO: 262 - DNA, 171 bp, Artificial Sequence
  Affymetrix ID 3764440
tgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgaca

SEQ ID NO: 263 - DNA, 32 bp, Artificial Sequence
  Affymetrix ID 3790080
ttgggaaagcagataaccctgaatgacatgga

SEQ ID NO: 264 - DNA, 25 bp, Artificial Sequence
  Affymetrix ID 2658005
gtattatcacatgactgccaggtgc

SEQ ID NO: 265 - DNA, 114 bp, Artificial Sequence
  Affymetrix ID 3029676
gtctgtgggtggatagatccattaatggataagtaaatgagcaatgcttcctgggttgaggttttggattactgtggtcatgcactgcattggagatgaggtggaaaaaccatc

SEQ ID NO: 266 - DNA, 121 bp, Artificial Sequence
  Affymetrix ID 3390272
gagtgggcactaggaaacggattcaaagaggcgatgaataatctgagttttacaggtttaacaggaaggcataacattgtaagcaaagaaagaaaagatattccagacaaagcatatgtgg

SEQ ID NO: 267 - DNA, 145 bp, Artificial Sequence
  Affymetrix ID 2642810
ctggatggagtaagagcctctggtaatagagatgtttgtgtaaaaatgacaccaacccataaaggtcagcgatgggggttactcagcatgcctgttgatgaggaagtagagagccttcacctcaggttcttagctacgcctccaa

SEQ ID NO: 268 - DNA, 25 bp, Artificial Sequence
  Affymetrix ID 2811129
gatgagatattaactgctgcactgg

SEQ ID NO: 269 - DNA, 48 bp, Artificial Sequence
  Affymetrix ID 3070222
tgagaaaatggtggatcatagaggagtacgggtagtggcatttggaca

SEQ ID NO: 270 - DNA, 62 bp, Artificial Sequence
  Affymetrix ID 3907114
cctgcctgaccttacccagagaagccatgggccacctgctctgtgcccgctcctgaaaccca

SEQ ID NO: 271 - DNA, 110 bp, Artificial Sequence
  Affymetrix ID 2790942
atgttcccataagcaacagcctgtaaattgtcacatgtaagtcatctaataagtttagaacaatgaacaactcattttctgaactgggacaaacaaggaagctaaattca

SEQ ID NO: 272 - DNA, 47 bp, Artificial Sequence
  Affymetrix ID 3043075
aatcagtgttgcctggtggatagcaaatcaagtttcaaggttacaga

SEQ ID NO: 273 - DNA, 66 bp, Artificial Sequence
  Affymetrix ID 2354095
ccatggtgaaatggtgggaccttgatactcagcactgctttaaaacaatggttggccaccggactg

SEQ ID NO: 274 - DNA, 143 bp, Artificial Sequence
  Affymetrix ID 2713294
tggattgcgtaaaggtggggacctccagatcttccacgggaaaggtacgtttttcttgttgatattgtgaagtgtgtatggggttgtactttggcaccttgtagtgagtcagtttccccccattggtgatcattgccaaatca

SEQ ID NO: 275 - DNA, 104 bp, Artificial Sequence
  Affymetrix ID 3220577
agatgttgcatcaaagggccttgggttggtttatgaactaggcaatgaacaagatcaacaggaattggtttctacacttgtggaaacacttatgactggcaaaa

SEQ ID NO: 276 - DNA, 34 bp, Artificial Sequence
  Affymetrix ID 3531076
tgttactcgtattttggacaatcttatggagatg

SEQ ID NO: 277 - DNA, 37 bp, Artificial Sequence
  Affymetrix ID 2505303
gcaggaagaaaacttcgagttacaggtcaggaaaagc

SEQ ID NO: 278 - DNA, 100 bp, Artificial Sequence
  Affymetrix ID 2644040
gagatcatgcccaattatgccaagaacatcattgttggttttgcaagaatgaatgggaggactgttggaattgttggcaaccaacctaaggtggcctcag

SEQ ID NO: 279 - DNA, 47 bp, Artificial Sequence
  Affymetrix ID 2938530
gagaatgccggtggggccttcagcagcagcatcctaacagtgttgca

SEQ ID NO: 280 - DNA, 198 bp, Artificial Sequence
  Affymetrix ID 3625346
gaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatc

SEQ ID NO: 281 - DNA, 283 bp, Artificial Sequence
  Affymetrix ID 2971361
ctgcctagtattgtgctacagtaccagacaaaatcactttagggttttggggattttgtttttttaaacaaactggtatgtaatataaacttaggaaccaccaccaccatctcgagtatcaatgtttcagaatggaggcatagttcagtgaaaaaaatgccggcattggttttagttttgattcttgtttcaccagaaagcatggtggttgggggagctgtcaaagtactccggatagactcagcgccattaaataagctcaggcatatacggccaggagcaa

SEQ ID NO: 282 - DNA, 26 bp, Artificial Sequence
  Affymetrix ID 3026661
aagtgtgagcgcctacttttatttct

SEQ ID NO: 283 - DNA, 59 bp, Artificial Sequence
  Affymetrix ID 3108906
ctgcatcgaaccagcgacctgggtgcctccccacccaagacggacctccacatcgggaa

SEQ ID NO: 284 - DNA, 72 bp, Artificial Sequence
  Affymetrix ID 3649134
ccagcagccctttatcaataaggcctccaacagtgttcttcaatccagaaatgctccgcttccatccctgca

SEQ ID NO: 285 - DNA, 39 bp, Artificial Sequence
  Affymetrix ID 3729183
ttattgaagttggcacaccacctacagggaaccagccct

SEQ ID NO: 286 - DNA, 105 bp, Artificial Sequence
  Affymetrix ID 3900156
tcccaacaaaatcgtggcccaggtagcttgcgatgtccttcagttgctggtttcctactgggagaagcttcagatgtttgaaacctctctgcctcggaaaatggc

SEQ ID NO: 287 - DNA, 27 bp, Artificial Sequence
  Affymetrix ID 3907653
tttcctctttggaactcttgtgttgtt

SEQ ID NO: 288 - DNA, 177 bp, Artificial Sequence
  Affymetrix ID 3102604
ttggtcttcacgcactgggtgtgtctgtaaatacagcgctgtccacggtgtctgtcctgcttccatcccaaattcaggctttagcttaaaacatctttagtttaattttttaaaaaattcttttctttcccccagataaaatcttaatcttttgcactagactgttagccagggaaa

SEQ ID NO: 289 - DNA, 25 bp, Artificial Sequence
  Affymetrix ID 3863282
gaagtgtttccagacatcccaattc

SEQ ID NO: 290 - DNA, 25 bp, Artificial Sequence
  Affymetrix ID 2920506
gcttcttcgtggtcttttccattat

SEQ ID NO: 291 - DNA, 48 bp, Artificial Sequence
  Affymetrix ID 2319069
ctgaagcagggtgcccgtttctacaccaaagagcggcaaaatgaagaa

SEQ ID NO: 292 - DNA, 27 bp, Artificial Sequence
  Affymetrix ID 2573693
gcttctgggcctgcagaacttactgaa

SEQ ID NO: 293 - DNA, 65 bp, Artificial Sequence
  Affymetrix ID 3022667
gtgcccgagtagagaaagtcgagtctcctgccaaaatacatgtcttctacattgactacggcaac

SEQ ID NO: 294 - DNA, 166 bp, Artificial Sequence
  Affymetrix ID 3570810
atgtgggtggagatgatctttgctttgagaacaggattcattatgtgggctggtcaggagtgggaacaagagcaggaaggccacaggggattgagagtacttctgtccccaacacactcatcaaggacgtgcaatcgggggccaaggctcattatggtgattttca

SEQ ID NO: 295 - DNA, 234 bp, Artificial Sequence
  Affymetrix ID 3847162
tggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctct

SEQ ID NO: 296 - DNA, 37 bp, Artificial Sequence
  Affymetrix ID 2535304
tcaacaacatgaatggcggcaacactaggagacatcc

SEQ ID NO: 297 - DNA, 46 bp, Artificial Sequence
  Affymetrix ID 2697615
tgcagtggtactattttagctcaatgcagccttagattcttggact

SEQ ID NO: 298 - DNA, 91 bp, Artificial Sequence
  Affymetrix ID 2931795
agatggcatgctgcacaagggattcatggttacagcgggcttgtgggactggggctctccaatacgtggttgggtttgtaaagaaatcaga

SEQ ID NO: 299 - DNA, 111 bp, Artificial Sequence
  Affymetrix ID 3011882
caggttattgaacttgcccgccagttgaatttcattcccattgacttgggatccttatcatcagccagagagattgaaaatttacccctacgactctttactctctggaga

SEQ ID NO: 300 - DNA, 200 bp, Artificial Sequence
  Affymetrix ID 3464921
cctgataataagaggaacgaggacagctcagaaagtacaagtcaagaagccctgagaggggagtgaattcaggaaaccggacatttcaggtttgcctcagcattgcatgagtttgaggaacaagaaaagatgaggatggattgtgaatgatctcgaatgtgttttgaaggtttttggaggtatttggattcaccctaaga

SEQ ID NO: 301 - DNA, 150 bp, Artificial Sequence
  Affymetrix ID 3541610
aggtcgatgggctcagaattcactgacaggttcagatccagccgagaagtggagcatgtatggtattagtggcatttgaaggtcattagtggcataactattgtagtgtaaattcaagttttattggtatattgtgtatagccctgcaga

SEQ ID NO: 302 - DNA, 444 bp, Artificial Sequence
  Affymetrix ID 3872499
ttaggagccatcaacgagttcacgccggagaaagacctttcaagtgtggagaatgtgtgaaatctttcagtcataagcgcagccttgttcaccatcagcgagttcacagtggagaaagaccttatcagtgtggagaatgtgggaaatctttcagtcaaaagggcaacctcgttctacaccagcgagttcacactggagcaagaccttatgagtgtggagaatgtgggaaatcatttagttcaaaaggacatcttaggaaccatcagcaaattcacactggggacagactttatgagtgtggagagtgtgggaaatcttttagtcataaaggcaccctcattctacatcagcgagttcaccctagagaaagatcttatgggtgtggagaatgtgggaaatcttttagttcaatcgggcaccttaggagccatcagcgcgttcata

SEQ ID NO: 303 - DNA, 58 bp, Artificial Sequence
  Affymetrix ID 2470335
aaggcgttcgttatgtgggatatgctgttaccactgaacttgaagttatcaaagaagt

SEQ ID NO: 304 - DNA, 92 bp, Artificial Sequence
  Affymetrix ID 2887649
ggtaagtggattgacctctaaactccctagaagggctgtagctttgaaggtggacatttattgggctcgcacgtgacacttattggggctaa

SEQ ID NO: 305 - DNA, 28 bp, Artificial Sequence
  Affymetrix ID 3522210
gtgagaacctacatgttgggtgcccacc

SEQ ID NO: 306 - DNA, 116 bp, Artificial Sequence
  Affymetrix ID 3674221
agtgagcgtttgagtgaaccagccacagtctctacgtgtcatccaaggagcccggcacagaccccgtgtcacccccatgtcacccgcagaccccgcgtcacccatagatacgcaca

SEQ ID NO: 307 - DNA, 98 bp, Artificial Sequence
  Affymetrix ID 2560167
gggacacagagcagttgaggatatctcttttctttcactctgttctgaaatctgcctcttcccaaaggtactccatgacccctaagatactcactctg

SEQ ID NO: 308 - DNA, 65 bp, Artificial Sequence
  Affymetrix ID 3041159
ttaattcagcacaactcaccattcccactggaaacatactggcaattcacatcttccaaacaagg

SEQ ID NO: 309 - DNA, 27 bp, Artificial Sequence
  Affymetrix ID 3183335
gaggcactcaggccaaaacaggaaaaa

SEQ ID NO: 310 - DNA, 86 bp, Artificial Sequence
  Affymetrix ID 3204049
gggcgccatcggatggggcaaagagatccctgaaaacgtattgccgggggacggggacttgcaggacaagaaaaccgtgggagaat

SEQ ID NO: 311 - DNA, 118 bp, Artificial Sequence
  Affymetrix ID 3393003
gttgattgtaaacccacagtatctagcagcgttgtgccaaattgcccttgtgtttctctccacccaaaatatcacagctgctttcctcacatttggttcatccgtgtgctgttctttt

SEQ ID NO: 312 - DNA, 427 bp, Artificial Sequence
  Affymetrix ID 3598130
gccaagtacaaagtgctgtcccatatattacctttatcatcatgacaagcacttgagatggtaattaacaactccactttaagtctgagaataatgaagcaactgacccaaggctccaaagacagtgaatggcagagatgagattcaaacccaggtctccctgactcgaaagcccacgctttcccccaacaccatgttcttttccttccctgtcagaaagggaaataccaaaaacaaatgagggtatgtatgagggtttggctggagccccagtcagccaaagtctgattccaagtggactgcagggtccgtgttatctcccttgggcacaatctcaaaagcccagaattcagctgccttgctaaccttccatcccagtcttagtgagaagctaaactaacttctgggcctcaattacagcagatta

SEQ ID NO: 313 - DNA, 233 bp, Artificial Sequence
  Affymetrix ID 3681604
tgccatagaccctcacgtgtttgttgcattaattggataattcaaaatataaagtattatccagtttcaggataatattaagatctaaaccaatgaatgctctatgaaaagttgtagattaactgatcccttaaaactaaaaacagcgtcttcataagcttctactgggggcagctaccactttcttcatcacatttcttatcctcaatagctgtgggcaatgccaaaatagc

SEQ ID NO: 314 - DNA, 646 bp, Artificial Sequence
  Affymetrix ID 2410882
gttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttcta

SEQ ID NO: 315 - DNA, 70 bp, Artificial Sequence
  Affymetrix ID 2821250
agggccagatgatgctatagacgccttgtcatctgacttcacctgtgggtcgcctacagctgctggaaag

SEQ ID NO: 316 - DNA, 45 bp, Artificial Sequence
  Affymetrix ID 3134070
gattggagcaatgatgtaagagctgaactagcaaaaacccctgta

SEQ ID NO: 317 - DNA, 971 bp, Artificial Sequence
  Affymetrix ID 3888286
agctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactccca

SEQ ID NO: 318 - DNA, 149 bp, Artificial Sequence
  Affymetrix ID 3919790
gcagggagtgcagaaaccttggagaaagtgagagttttccagccaaagggaactttgtgtttccctggctgggactcttggggatctttttcaggttttctgcagtttttctgaattgagctttaaggcaactggatggattttgaact

SEQ ID NO: 319 - DNA, 144 bp, Artificial Sequence
  Affymetrix ID 3948965
cttagctgttccagcggcccatgtttaaaagaatgtgcttctttttccaagtatttctgccgcttgcatgcactgagcttctttggaaaggagcaccatgcaggcatattttccagacaggaccggatttgctcgttactcaga

SEQ ID NO: 320 - DNA, 458 bp, Artificial Sequence
  Affymetrix ID 2738676
ctgagacctgaagcacgagagccaagtgtgtaagcaagtcgatgggattgggaagaagtttaggctgctaaaaaatttttacataaagcttgataagaggggatattgcatgtgaaataaacagaaattcagtaaatatggtggaagtgcaggatttaggggatggaaaaaaatactagtttcaaaaattgaggctagaagtgaaggtaggggccagattatgaaaagccttgtaagcaatgctaagaaacaatagatgtcagaaggacatgccaccatctaaaaagcagtcttgagaacaagtaattggataaaggtgacctgactaggtatttgtttttttaagtaaattgtgttaattttgttaggtgtaaaaatggcattagggtcatgttggggaaaaaagaatctctttcttacagatgaaattacatggtctctgagactgcttccaaaaa

SEQ ID NO: 321 - DNA, 188 bp, Artificial Sequence
  Affymetrix ID 2929182
tgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccattttttcggtactagcatggctcactgc

SEQ ID NO: 322 - DNA, 201 bp, Artificial Sequence
  Affymetrix ID 3004581
gcaaatgttttaatgggccctcctaccttacctgacataagataattcatactagaaagaatacctacaaatgtgaagaatgtggcaaaagctttagtgtattctcaacctttactaatcataaagcaattaatactggagagaaatcttacaaatatgttgaatgtgacaatgtttttaactaggctgcaactcttgctg

SEQ ID NO: 323 - DNA, 27 bp, Artificial Sequence
  Affymetrix ID 3300811
tttggatttaggtggcgagtagaaaaa

SEQ ID NO: 324 - DNA, 65 bp, Artificial Sequence
  Affymetrix ID 3426258
atggagattaagcaggaacttcaagaaagccaagctcttcttggtagcacaccagagtctgaagg

SEQ ID NO: 325 - DNA, 38 bp, Artificial Sequence
  Affymetrix ID 3645807
agtggaatctctgaaactcaggtgtggcatcaacaaag

SEQ ID NO: 326 - DNA, 298 bp, Artificial Sequence
  Affymetrix ID 3976960
caaatcccgggtggcagccataatccccaaagatgacccccaccccaagattccaaagaagctagtggtggtggaagcaaaaggaatgcagcaaggtcagggtttcattgtccaagccggcctgacacctgccgccctgcccttgcccagtgcacaccctagaccctgggccggcctccatgcagctggaggccagaagacagcaacccatatctttgcaccctcctccatgccccatggcctgcctgcccagaaagatgccaccttcacagagccagtgctgtcgtctatatcattt

SEQ ID NO: 327 - DNA, 29 bp, Artificial Sequence
  Affymetrix ID 3981121
ccgtcgccgccatttcaagaccgtactag

SEQ ID NO: 328 - DNA, 292 bp, Artificial Sequence
  Affymetrix ID 2391399
gtatgcaccggcttatgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctggg

SEQ ID NO: 329 - DNA, 135 bp, Artificial Sequence
  Affymetrix ID 2748879
tgcgaattggactgcactctggatcagtttttgctggcgtcgttggagttaaaatgccccgttactgtctttttggaaacaatgtcactctggctaacaaatttgagtcctgcagtgtaccacgaaaaatcaatg

SEQ ID NO: 330 - DNA, 60 bp, Artificial Sequence
  Affymetrix ID 3063716
gtgagtggttagagaacaatggcaaacaaagggcgaggcgtttaagcttctgtagagagg

SEQ ID NO: 331 - DNA, 197 bp, Artificial Sequence
  Affymetrix ID 3361874
tgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatg

SEQ ID NO: 332 - DNA, 35 bp, Artificial Sequence
  Affymetrix ID 2812780
tctggaatgaaacagcgtaatgagatgagccctga

SEQ ID NO: 333 - DNA, 121 bp, Artificial Sequence
  Affymetrix ID 3065419
ctacaaggatactcaggtcagaaaggcccaggagtacctacctcattcagcaacagtccagtcaaaatcttcctccccgacaatggcctatgaccagcctgttctacacattcctctctgg

SEQ ID NO: 334 - DNA, 35 bp, Artificial Sequence
  Affymetrix ID 3077669
aagagcccttctcaatggcttaacccatagagccc

SEQ ID NO: 335 - DNA, 32 bp, Artificial Sequence
  Affymetrix ID 3652961
aagcggaggttggaggaagccgtgattgtacc

SEQ ID NO: 336 - DNA, 26 bp, Artificial Sequence
  Affymetrix ID 2895678
aaagcagccgtggagacaaccatctt

SEQ ID NO: 337 - DNA, 118 bp, Artificial Sequence
  Affymetrix ID 2978057
ctgtgttgtctcagtcaagcctagaactgaagctacctgacatcaagccaattgtccaggaccagcatttccagcacttccagttgtccatatctgcacttccaggagtaaacaggca

SEQ ID NO: 338 - DNA, 250 bp, Artificial Sequence
  Affymetrix ID 3595946
caaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagc

SEQ ID NO: 339 - DNA, 96 bp, Artificial Sequence
  Affymetrix ID 3628693
tataggaaatcatcaggagccaagtgtgtttatcagctgcggggacacatcactcctgttcggactgttgcctttagttctgatgggttggccctg

SEQ ID NO: 340 - DNA, 214 bp, Artificial Sequence
  Affymetrix ID 3734777
gtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgtttt

SEQ ID NO: 341 - DNA, 37 bp, Artificial Sequence
  Affymetrix ID 2806269
acagagctggatgactatggccaatttggagaaagag

SEQ ID NO: 342 - DNA, 97 bp, Artificial Sequence
  Affymetrix ID 2849121
atgaatcccaaagcgattactgccccacagatgtttggtcggctggacgttgccacaaatgactggactgatgggatattttctacgctttggagga

SEQ ID NO: 343 - DNA, 94 bp, Artificial Sequence
  Affymetrix ID 3012989
tcttattcttggccacgggaccaaccctcacaggggcactctatgcagaagcttccttcctaaattggaactcccactttgaccactctccttt

SEQ ID NO: 344 - DNA, 184 bp, Artificial Sequence
  Affymetrix ID 3184655
ttgcaaggcccacaccacgtggctgagaagtcaactactacaagtttatcacctgcagcgtccaaggcttcctgaaaagcagtctaacagcaaaagaaaagcttatattaaataaatagttaaatattaaaccttcaaaagaaagactcgacacaatgacacaaagcacattctggaggtcctc

SEQ ID NO: 345 - DNA, 74 bp, Artificial Sequence
  Affymetrix ID 2428776
gctgcccaagatgttggaacaccatgtgcaataaagggcttcgtcttggattttggccttattaccacaaccag

SEQ ID NO: 346 - DNA, 38 bp, Artificial Sequence
  Affymetrix ID 2502833
acggcccgggatgttggacttcacgggcaaggccaagt

SEQ ID NO: 347 - DNA, 28 bp, Artificial Sequence
  Affymetrix ID 2608589
ttccattgatgaattggataatgctgag

SEQ ID NO: 348 - DNA, 31 bp, Artificial Sequence
  Affymetrix ID 2781610
cttacaggagaaatcgaaacacagctgctac

SEQ ID NO: 349 - DNA, 29 bp, Artificial Sequence
  Affymetrix ID 2810989
ttagagtttatggaccttgctcttggtta

SEQ ID NO: 350 - DNA, 92 bp, Artificial Sequence
  Affymetrix ID 2489148
cctctgccttcgctcgcgccgctctccttcagtctccccagggcctgtttcatggatagggtccccttgcccgcgtgaaagtctcattcctc

SEQ ID NO: 351 - DNA, 326 bp, Artificial Sequence
  Affymetrix ID 3239162
ccactggctaataagcaggtctttattgagtgcccaacactgagtttagtcacaggtgcttattctggataattaatctcagtagattaaccttcttcagaatgaccatgtatatcagacttctcttatccccaattctgggtccttattaacctcttccagggctaagtatttacccttccataaatcggatgttttcttaagcattttttctcctgtcatcactgaaactccagcctagttcttcacttgtatgcaattttcttgtaaccctgtctctcgttttggtttattgtccatatgcctattgagtgcttttccagttg

SEQ ID NO: 352 - DNA, 96 bp, Artificial Sequence
  Affymetrix ID 3573019
ctgataggtcttgctggctacctgagtggatatgatggtacctttttgttccagaagcctggggataaatatgagcatcacagctacatgggaatg

SEQ ID NO: 353 - DNA, 98 bp, Artificial Sequence
  Affymetrix ID 3937196
ttgtgcccccaaaaagaggcgaacagaggaaaaatatggcggagacagcgaccatccgtccgatggagagacaagtgtgcagccgatgatgaccaaga

SEQ ID NO: 354 - DNA, 635 bp, Artificial Sequence
  Affymetrix ID 3154331
tgctgggcgtcaagcttgcataatgccgtactttgagggcggttgtcacaagtatcacaaaatgggtggcttaaagcaacagatatttattcccttttagttctggaagctaaaagtccgaaatcaaggtgtgggcagggccgtgctccctctgaaggtgctaggggagaatgctgcctgcctcttccagcttctggtggctgctggccacacttggttcaccttagctagtagacacatcactccagtctctgcctccatcctcactcagcactctcccgattgtatctctgcgtctatgtccaaatttccttcttcttttaataacatcagccgttagctttagggcccgctctaatccaatatgacctcatcttaacttgattttacctgcaaagaccctatttccaagtatagccacagtgataggtactggggttaggacttcagtatgtctattttggggacacaattcaaccacaacctacagcaaagggtaggtggcctgactgaggtggggtggccgatttgatggtagatccagaaacagaactcacttaggcctgattctggagacttccacagcgtcagtctaatgtgctgagtgccccgcctggaggaaaaattcgggcatc

SEQ ID NO: 355 - DNA, 149 bp, Artificial Sequence
  Affymetrix ID 3697772
tcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaa

SEQ ID NO: 356 - DNA, 31 bp, Artificial Sequence
  Affymetrix ID 2611934
gctatgacctcgctggggagctacaacaagt

SEQ ID NO: 357 - DNA, 393 bp, Artificial Sequence
  Affymetrix ID 3127807
caaggaagcgagtctccgtgacacgtggtacaatatcatgcagtacacacggaaccagaaccaagaagaaatggctggaaaagatgaaagaaaaaaaaagttgatatagtctcaaatgtagtgaaaaaacatcaacttatagattcaaaaagttcataaacccctcataaaaataaatgtaaagaaaaccctacctggacacatcatagtcatcatacagagcaaattttgtgcattcacaggtaacaaagatatgaacgacagctgactcaaaacaatggaggctcaggatgtgtgaaatggtgaaagaaagctgttgactcactattcacactcattgagaatatcctttaaaaatagtaagtgaagacgttgtggcaggttgaactttcc

SEQ ID NO: 358 - DNA, 637 bp, Artificial Sequence
  Affymetrix ID 3909039
agggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctcc

SEQ ID NO: 359 - DNA, 25 bp, Artificial Sequence
  Affymetrix ID 2412620
gtttctttgaggaacgcagcctgaa

SEQ ID NO: 360 - DNA, 31 bp, Artificial Sequence
  Affymetrix ID 3220615
gaccctaaactactgtcaatggcatattcag

SEQ ID NO: 361 - DNA, 27 bp, Artificial Sequence
  Affymetrix ID 3521230
tgctgctgacatcacgggccctgggtt

SEQ ID NO: 362 - DNA, 54 bp, Artificial Sequence
  Affymetrix ID 2327492
gacaatctttggcagacttggagcaaaagattgaggtgcatttcatgcctcctt

SEQ ID NO: 363 - DNA, 41 bp, Artificial Sequence
  Affymetrix ID 3557645
tgtcaacattcttggtcgcttcctactcaacagtgacagga

SEQ ID NO: 364 - DNA, 59 bp, Artificial Sequence
  Affymetrix ID 3709227
tgccgtcctcagtgaatcacagcagcttcaaaggactcaactggcaagatttcccacag

SEQ ID NO: 365 - DNA, 144 bp, Artificial Sequence
  Affymetrix ID 4021348
gagagcaagtaagctgtcccttttaactgtttttctttggtctttagtcacccagttgcacactggcattttcttgctgcaagcttttttaaatttctgaactcaaggcagtggcagaagatgtcagtcacctctgataactgg

SEQ ID NO: 366 - DNA, 316 bp, Artificial Sequence
  Affymetrix ID 3030989
agggcttgaccctgcctagatcctccttaccaagaaagggctgaaaagagagggcatctggcatgctttttgccacttctgtttctaggttatgtacttcatggaatatctgggcattgcttagaaacctgtgtcataaattggctttgggcaagaggctttgagttggaagaaaaggtggaaagaaagtgcttgggggcggagttcagggatttgacgggattgccagcgcttccaggccgtgtcatccaagaccagtgtggttgtgggcacattagcttggagacagtggcagcctcttgggactaacatcttt

SEQ ID NO: 367 - DNA, 150 bp, Artificial Sequence
  Affymetrix ID 3035657
agtccggtggcttagatgacaaatggaggtagaggacgcattctcgcctgttatttcgatttttttctctcctcaccctgaccgtcacgttctcaccttttccacctcaatccccagtcacactagcttcccaggattaaaatggtctct

SEQ ID NO: 368 - DNA, 141 bp, Artificial Sequence
  Affymetrix ID 3626930
tgctttcacttaaggcagggctgttgagtcggtgaggggatgagggcatctcaaaagaaggctggctttcaggattgcacagagatgttcctgctcccagcagactggggtaaaatttcctgggaatgagggcatttctga

SEQ ID NO: 369 - DNA, 80 bp, Artificial Sequence
  Affymetrix ID 3091396
caagtgagagtgattttgttacatgggatacattgcatagtagtaaagtctgggcttgtagtgcaaccatcacccgaata

SEQ ID NO: 370 - DNA, 28 bp, Artificial Sequence
  Affymetrix ID 3323928
cagtgcatcccggaaaaaagagagcaaa

SEQ ID NO: 371 - DNA, 53 bp, Artificial Sequence
  Affymetrix ID 3326853
tggccaagaggaagtgtccggaccatgggcttgatttgagtacctattgccag

SEQ ID NO: 372 - DNA, 45 bp, Artificial Sequence
  Affymetrix ID 3402333
caaagtcctttgcaagtctcacccttaagcgcgtggggactgtgt

SEQ ID NO: 373 - DNA, 209 bp, Artificial Sequence
  Affymetrix ID 3796317
tcacgttgctggctaccctcatatgtgtgatgactgttagttgtacaattacatttaagaaagaggattacattgctagctggaatttcttctactattataaaaatagaactgttttaccaacaagtctcttctccgagtgggacttgatggtaactataactgggatagggcaaatcaacgtcatgggtccacaggttttgctttaa

SEQ ID NO: 374 - DNA, 94 bp, Artificial Sequence
  Affymetrix ID 4020467
tcccaacaagttgaaccttgcgttacgataaaagcagatgtggcatccaatcctaccacccagcaaagagaaaccccaggcattcaactgcagc

SEQ ID NO: 375 - DNA, 292 bp, Artificial Sequence
  Affymetrix ID 3180404
catcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggtt

SEQ ID NO: 376 - DNA, 52 bp, Artificial Sequence
  Affymetrix ID 3781848
gaggaagtgtctggtccggtccctagagcatggcaggtatgcactcaatgct

SEQ ID NO: 377 - DNA, 65 bp, Artificial Sequence
  Affymetrix ID 3868844
tcaaggcattatctcctggggccaggatccgtgtgcgatcacccgaaagcctggtgtctacacga

SEQ ID NO: 378 - DNA, 40 bp, Artificial Sequence
  Affymetrix ID 2396267
tggggacggcaacaccgcgctgcaagtcgttatcattccg

SEQ ID NO: 379 - DNA, 25 bp, Artificial Sequence
  Affymetrix ID 2862752
tggtggatgtagtaatgaaagaaaa

SEQ ID NO: 380 - DNA, 89 bp, Artificial Sequence
  Affymetrix ID 3869672
ggagttgcatccttgcttgactaaaatggaagccgtattgattttgaaatgaaaagcttcatgatgtagcatctggactttcactgtcc

SEQ ID NO: 381 - DNA, 43 bp, Artificial Sequence
  Affymetrix ID 3876038
taaggatttcaacacacgtaaggccatgtttctgatgttatag

SEQ ID NO: 382 - DNA, 54 bp, Artificial Sequence
  Affymetrix ID 3879228
ggggagggacatgacttcctgttacgggatgaggaagtagaggttcatggagga

SEQ ID NO: 383 - DNA, 82 bp, Artificial Sequence
  Affymetrix ID 2399914
ttagacttgaaagaacctcgttcacctgccacatgctatcctagggaattaatagcttcccatgtggacactcactctatgt

SEQ ID NO: 384 - DNA, 274 bp, Artificial Sequence
  Affymetrix ID 3142073
ggggaacgaagcctgacaactcctaagtttctggcttctacaaccatttagtgaaggtttcattaatggcaggcaggagtacagttttagaaggtctggactggagagacatttgggggaatcatccgtgagtatcgagagttaaagacatgccaggaatagtgtatacaattaaaatagacaggggcttgggaaatgccagttcgcagatatatatttgtcataagtgaactaaagaaaaggtatatggttggatgagcttaaacccagcatg

SEQ ID NO: 385 - DNA, 2578 bp, Artificial Sequence
  Affymetrix ID 3777286
cgcagttcatgacttgtaccagtgaaggtagcaaggtctgtgtgttggtgatgaatttgcaggggatcaggctgaagaaacaagacttgggagagaggatgtgagacctttttatgacatgcatagagttggcacctcagcctttgcatggtagggagctagctgaaggctacctccatgacagatgtacactttgaaaagacaggccgggtgcggtggctcacgtctgtaatcccagcattttgggaggctgaggtgggcaaatcacttgaagtcaggagttagagatcagcctggccaacacagtgaaacctggtctctactaaaaaaaataaaataattagccaggcatggtggcgcacacctgtaatcccaactattcgggaggctgaggcagaagaattgcttgaacacgggaggcggaagttgcagtgagctgagatggcaccaccgcactccagcctgggcgacagatcaagactccatctcaaaataaaggaagatacagctaatctatatttctttcaccagagatcaccaccactaacaattcatactggtcgtttttccctgaatgttttacctatgtaggaaaattttacatcccaatttttaatttaacactatgaaaagcatttctttttataataaagacactctattagtatacttttgatggcttcaaaactacttttgtatagatgcaaaattaaaatatcaaattgtttcttttgtttgtttgtttttttgttttttttttgagacagagtctcactctgtcgcccaggctaaagcacagtggcatgatctcggctcactgcaagcttttcctcccaggttaaagtgattctcatgccgcagcctcccgagaagctgggactacaggtgtgcaccaccacccccggctaattttttgtatttttacaaaacacaaagagagacggggtttcaccatgttgggcaggctggtctcaaactcctgacctcaggtgatccgcctgcctcagcctcccaaagtgctgggattgcaggcgtgggccaccgtgccctgcctcaaattgtttctttaatggttgttcccaaattttcataaataactttttacgtaacatttttgggcataaagttgtctaaaattattttcataggctagataccttaagtacacttaatgatttaaatcatacttaacattaagactttaatgttgctatattgatatttagtaaaagtacaaaacttgtgctttagagtttagacatattcaggatataagatagttttgttggatttggcgaacacttgccctaggagaataaaaaatgatgaattagtccaaaatgttccagttttctaatttgtcagactcggtaaatggtatcatcaccaaccaagaaaaacagaagatacagggagagtagattttgcagaaaagataaggagttctgtttgggacttgctgcctttgatatactgcactgggagaaaatccaagtcgaacagagtggacaagtgagaatgtgctgtggaatcaacaagaggggtggggagtctacctacctagatttgagagcagtttggcaaataattgttagtaaatgtcatagaaattcgtgggagagagaagttgataagaacagaggggtaaaggatgaaacagaggaaacactgccgcttctcagggttgggtacaagagaagccagggaaatagactaagaaagagtgatcagggaaaccgggagacagtgttgtcacggaagcctggagtgtgagattttccagaaaagaaggaatgaaagaatgaatggtctgtagatccattactcagcactatcagacacattgtccccttttgatatcccataatgaaatttatagataatataatctacttgtgcacaaaattttagaaattaatataatgccccaactataatataaagtgtattagtcagggttctctagagggacagaactaataggatatatatatataaaggggagtttataaagtattaacttacactattacaaggtcccacaataggctgtctgcaagcttgaggagcagagagccaggctgagtctcaacactgaagaacttggagtccgatgttcgagggcaggaaaaatccagcacaggagaaagacgcaggctgggaggctaggccagtctctcctttccatgttcctctgcctgctttatattcactggcagctgattggattgtgcccaccagattaagggtggatctgccttccccagcccactgactcaagtattaatctcttttgacaacaccctcacagacacacccaggatcaatatttgtatccttcaatccaattaagctgacactcagaattaaccatcacataaaggaagaagtaaaaggaaagtatattttatataataagtatttaaatatgtaaacattgggacatgactaaaactgactgaacacattgaaggagtcacttggttggtctgatgtgcagaattaccatgcatgctacaaatggagaggggtctacatgagctgtattgcttgtggtgccgcagatgacttgaatttc

SEQ ID NO: 386 - DNA, 42 bp, Artificial Sequence
  Affymetrix ID 3851492
ttttttacggattcagtgatctggacgggcacatactaccat

SEQ ID NO: 387 - DNA, 75 bp, Artificial Sequence
  Affymetrix ID 2712928
gtgagtaaaccatggcgtgtttgttggccaaaagccgcaagtctttgaaaaggtgaatcatcacttttccattta

SEQ ID NO: 388 - DNA, 207 bp, Artificial Sequence
  Affymetrix ID 3060349
ctctggaggcttcttgtcagtactagaaactaatacttggtgaatatccttttctgcttccattaccttgtatgaaactggttccatttatacactgagattagaagcattcataagtgatgcggcaccacaaacacagaagatcaaactactcacagtgtggagaaccatgtcttttataagtgtgatgtgcctaaaaccatcatc

SEQ ID NO: 389 - DNA, 25 bp, Artificial Sequence
  Affymetrix ID 3504762
aaaccccaaaactgtccaggcatgg

SEQ ID NO: 390 - DNA, 222 bp, Artificial Sequence
  Affymetrix ID 3543824
agtcttttataagtgttggctatcattttttctcatctatttccttgcttctggttttgcacactttaccatccacactgccatcagagtgatcacacctctcttcagtagctcccatcatctactgcataaagctgagactgttagctagactgttaggcacctttcccacacgatctggctctgccccacttcccagcctcagcccacatggctaaacaa

SEQ ID NO: 391 - DNA, 89 bp, Artificial Sequence
  Affymetrix ID 3781951
gatttgggcttaccacctactgaccacctccaggcctcatttggatttcagacctttcaacccagtggcatattattagatcatcagac

SEQ ID NO: 392 - DNA, 74 bp, Artificial Sequence
  Affymetrix ID 3216926
aacactgatctccacgagcacaatcatccaaacggagatgggaacccctgttctaactctctcagaggcctgaa

SEQ ID NO: 393 - DNA, 141 bp, Artificial Sequence
  Affymetrix ID 3448246
ctctttggtatattattgcagatgttgttatttcacagttaggtaaattagacataaaaaggtcaaacgacttgaacgtgctaccataaaaggtcagtgataaagccagaagtcatttctcagtgtccatcataagccacc

SEQ ID NO: 394 - DNA, 66 bp, Artificial Sequence
  Affymetrix ID 2693224
ggagatggctgggtttatcataaaccactttggaaaataattccaacaacacaaccagcagagtga

SEQ ID NO: 395 - DNA, 107 bp, Artificial Sequence
  Affymetrix ID 2672926
tatgttcatgcggatgctcctaccaataaaacactggctgggctggtggtgcagcttcttcagttccaggaagatgcctttgggaagcatgtcaccaacccggcctt

SEQ ID NO: 396 - DNA, 188 bp, Artificial Sequence
  Affymetrix ID 2914136
ccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctc

SEQ ID NO: 397 - DNA, 84 bp, Artificial Sequence
  Affymetrix ID 3210858
tttgctctgaaaggcagtttctgtataggttcctccgagtgaagatcagaatgttatcagacactggctgtagctcagatgaca

SEQ ID NO: 398 - DNA, 25 bp, Artificial Sequence
  Affymetrix ID 3853401
acttggaactctgggacaaatagag

SEQ ID NO: 399 - DNA, 172 bp, Artificial Sequence
  Affymetrix ID 3605225
tggacccatctcagcagtgctcaaaccaatgcccaaactctcctgcttaggacacttctccactggccaccctgaggccaccacacctcactggccactcctcctctatcttctctgctggctcttcctcctctatggccacctaaaggatgggtgttacacactcaatcct

SEQ ID NO: 400 - DNA, 265 bp, Artificial Sequence
  Affymetrix ID 2377461
tggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagcta

SEQ ID NO: 401 - DNA, 78 bp, Artificial Sequence
  Affymetrix ID 2934549
gtgtgctactggcttatggctgatacgtaagagaatctcatctatctctaaatgttctgccttaagccgcacaaagga

SEQ ID NO: 402 - DNA, 160 bp, Artificial Sequence
  Affymetrix ID 3185031
tggcacatgtggattctataccttaattaaagccactcccttacatacacacatttaggtatcgccagactcgcctgatgaggaataattattctttcctccatatttcttaactcctgtcttttccatgaaacggcttggcattaaactccttcccaga

SEQ ID NO: 403 - DNA, 44 bp, Artificial Sequence
  Affymetrix ID 3560964
gtaatgtggcggtcaaaaccggcgctggaaccacgggacatgtt

SEQ ID NO: 404 - DNA, 81 bp, Artificial Sequence
  Affymetrix ID 2732616
aacgtggagccatttaccagtgttcttagtttgccatacccatttgcttccgaaatcaataaagttgctgtatttacagag

SEQ ID NO: 405 - DNA, 217 bp, Artificial Sequence
  Affymetrix ID 3150536
gccactcattcatggttgttctatgttccatgaactctaatagcccaacttatacatggcactccaaggggatgcttcagccagaaagtaaagggctgaaaaagtagaacaatacaaaagccctcgtgtggtgggaactgtggcctcactcttacttgtccttccattcaaaacagtttggcacctttccatgacgaggatctctacaggtaggtta

SEQ ID NO: 406 - DNA, 718 bp, Artificial Sequence
  Affymetrix ID 3774169
atcgctgtaccattctggggcactggagatggcagctgagaagcagagaagctggagacctgaagcctccacccttggctgtggctgccgagagaggcccctgcagagggagccccaggccacacccagacaccacagccagctcacagtgcggccagagggcacaggctgcttggggggtgagggtccccattcctgccacctctcacagaccatgacccacagggctgggggcttcccctgggagaaagtccttccctccccatggcccagccctggggaaagaaagcagagactaactcagggactgcagtaggctgaggacaagggaggtgggcttggggtgaaggccccccctcactcgcagagaagggacactaccggcagtagaggacagggaggcaggacgacggcagttagagacgaggcgtttcaggtgaactgtatgtagtgttactccggacgtgagcatggcctgggtcagtcgaatgaaatgagctgggcctcgctgccctgtgccggcggcccctgtgcctgcggttgctgggccacggggggctgctgctgggggggaccgccagagggtgccatctgtgcaggaggaaagcaggcatggccctggtcctcccttccccagcccagggaggaaggcttttgtcccagcagagccacagacccacaagtgcttgtaatccatgtccacggactgcagctcatg

SEQ ID NO: 407 - DNA, 276 bp, Artificial Sequence
  Affymetrix ID 2987860
cccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctga

SEQ ID NO: 408 - DNA, 213 bp, Artificial Sequence
  Affymetrix ID 3829652
atgtgactttacaaccctcggtgtcctcctggctgctgggccccagcctcctgactgttcagctcacacacgtgaacctaacacctgccttggtcccctgctccatcttctagacaactcatgctgaggaccagcccacaggaggaggcctccgagttctctcttgacgtcttcaccttgaccttttttgccaccattttagtctgtccaggc

SEQ ID NO: 409 - DNA, 179 bp, Artificial Sequence
  Affymetrix ID 3900228
gaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatc

SEQ ID NO: 410 - DNA, 50 bp, Artificial Sequence
  Affymetrix ID 2858280
ataaaatacaaactctccaacaagaccttttggccatcaggaacgcagca

SEQ ID NO: 411 - DNA, 25 bp, Artificial Sequence
  Affymetrix ID 3088555
aactgcccggttcttcaaatctgac

SEQ ID NO: 412 - DNA, 259 bp, Artificial Sequence
  Affymetrix ID 3850502
gactgtttgccaatggttgtatttagtaagatttgtagactctgtttttcttttgacacagctgcaaggccaacagctgtgcaaagccacaagttatgctaagtcagcagttatgctatagattacatgacctgtgactgtatcattaactgcttttgttttgcttctgtaagtttgcctataaaaaccacactcagtctttgttcaatggtcagcttttcagatacaaatccactgagccggtgtacatctaaataaa

SEQ ID NO: 413 - DNA, 114 bp, Artificial Sequence
  Affymetrix ID 3946288
tgtggacaagcgagcgatgaatctcggggattttaatgatatcatgaggaaggatcgatctgggttccgtccacctaattccaaagacatgggaaccacagatagtgggcctta

SEQ ID NO: 414 - DNA, 73 bp, Artificial Sequence
  Affymetrix ID 3430162
agtctggttgaatatttagatgtgaatgaagaaaatgattgtaacattgcactgtacgaacacacaattaata

SEQ ID NO: 415 - DNA, 28 bp, Artificial Sequence
  Affymetrix ID 3751732
gaatatgcatctttacaagcatccacag

SEQ ID NO: 416 - DNA, 25 bp, Artificial Sequence
  Affymetrix ID 2347259
tggctgcctgacattattgggtgct

SEQ ID NO: 417 - DNA, 25 bp, Artificial Sequence
  Affymetrix ID 2421262
ctccctgcttggcttgatgaccttt

SEQ ID NO: 418 - DNA, 154 bp, Artificial Sequence
  Affymetrix ID 3886689
gtatggtcttgggtttctgctgagaaatggcttgtaggtggggggttaaagttcctcacacctctcctgaacgggaggaagctgctgttcaccagtttccagtgctcaatgcgggcaggtggggcatctgtgcgtttggtaaatacatgatgtt

SEQ ID NO: 419 - DNA, 48 bp, Artificial Sequence
  Affymetrix ID 3951993
ttgagcccagtggcgggactccacgacgtagacctctctccttctgcc

SEQ ID NO: 420 - DNA, 342 bp, Artificial Sequence
  Affymetrix ID 3966982
ttcctgctgaccaacctaattctggtttcatacagggcagccaggtgcccacctaaaagactgcacttctcaacttccagttgtttctatggataatggttggaagcagaaattgggttggggcttccagataatcccccctcacagggactgcttcaagagaaagggatgccctttggttctttctcctttccactgcctggaatgtgatgtctgacactgtggcagccatactggcataatgaggccaactctctgccatgctaagagtggcagagctgggaattgaaaagagcctgctagccttgggttgcttccccttgatcggctcattacttggaa

SEQ ID NO: 421 - DNA, 117 bp, Artificial Sequence
  Affymetrix ID 2756515
tgagcgccttgtagtccaggttgcccgccacatcgatggaggcgaactggaacatctggtccacctgcgggcgggggcgaaagggctccttgcgggctccgggagcgaattacaagc

SEQ ID NO: 422 - DNA, 76 bp, Artificial Sequence
  Affymetrix ID 3261869
tttttgtattctagtcgttcagccccctcccctcccatcttccagcgcttctgaacaactcctactgttctcttcc

SEQ ID NO: 423 - DNA, 138 bp, Artificial Sequence
  Affymetrix ID 3391839
ccctatagattgtttgaggaccctattaaatattgtatagcctctaggaataagcctttccattgacttgctgtgataaacagatcttttgtcagcgactcttaaaatacaaaacagccttgggcagtagagtaccac

SEQ ID NO: 424 - DNA, 487 bp, Artificial Sequence
  Affymetrix ID 2437406
gcttccctgacctagacagtcctgactgatggtccaacctcaatcccacttatttttggctaggccttcctgggagtcataaaagagatgaatccattctagaggtgcacagcctgtctcttccctcacaaatgtcagtccccaagtcattctgatccaccttcctaatatttttgccacctccaacttctttcaagatgaaaaggaaatgtagagaagcaaggtcagggtagacacttaatcccactgactgtctttaatccactcttctccctctcaacctggatgatctccacactcctatccatactcagatacaggatatattgttcccctattatgtgctaagcactttcatatcccttgccttgcttaatctttacagtcctgtgaagtaggaattttatccccagctgaggaaagagactgagcgagaccgacttgctcaaggtcacacagtttttcaccaggggtagcagtgttcacg

SEQ ID NO: 425 - DNA, 259 bp, Artificial Sequence
  Affymetrix ID 2802671
tagagttagagtcagggccctggtccctggtgctctttcctggtcgcttctcatagccaggacgttgcttacattagttctcaaccccactgggaccaatcatttttattgccaatctattttggggctctgttctcgtggcaataaatcattctttcagagctccctatttaaccttgtgagagcgtgtgtgtgtggtggaggtgcttacataaatgcagtatttttaacctgcctggcacgctttaggttggcgtta

SEQ ID NO: 426 - DNA, 287 bp, Artificial Sequence
  Affymetrix ID 3415835
aagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactg

SEQ ID NO: 427 - DNA, 153 bp, Artificial Sequence
  Affymetrix ID 3764797
tgggactgtcaatcattggctctgcctctctgaccacagactaaatatatgaccagtctaacctgttaagcataacaatatggacactgggagagaagcctcttgaaatcctttgctgaacggatcatgtacaagctgccaagagttcatctc

SEQ ID NO: 428 - DNA, 45 bp, Artificial Sequence
  Affymetrix ID 2431813
tgatgcacagtttaggagcaggaaagccatgtcttggatccagga

SEQ ID NO: 429 - DNA, 103 bp, Artificial Sequence
  Affymetrix ID 2468734
tgcccaagtccttgaatcctacagaccttgctaatggctccgttcacgacacccaactggtcctgaactcttaggattaacccgtttgcttatggctgaggaa

SEQ ID NO: 430 - DNA, 154 bp, Artificial Sequence
  Affymetrix ID 2512616
cctaactaggagagtgttttcaagggagagattgctatagcatcagcctcttgggtttggagaatgagcttaaccatgagatttaggtttgagcatgtttactataagtaaaaagcattttcctggagtctggcaaatattgtggaagatgtac

SEQ ID NO: 431 - DNA, 167 bp, Artificial Sequence
  Affymetrix ID 3242348
aagagaatgggcaaagggagcgggtaggatggcggccgcaccaccagccacggactgggagaggcccttctgtgtttccagatgagaagagagctcaaggaatcccaggaatagactccatggaaaagaatgaaaaaaatcagagaaaagccaaatatccaaaagag

SEQ ID NO: 432 - DNA, 80 bp, Artificial Sequence
  Affymetrix ID 3316358
tgggtgagttcaacgagaagaagacaacatgtggcaccgtttgcctcaagtacctgctgtttacctacaattgctgcttc

SEQ ID NO: 433 - DNA, 101 bp, Artificial Sequence
  Affymetrix ID 3473828
tcccactagcgatcagctgacattcctaactgaaggctgcaatgtgttgcttattcattttgtaccgtgggagctgcggggactagcagagagctaaacta

SEQ ID NO: 434 - DNA, 53 bp, Artificial Sequence
  Affymetrix ID 2453074
cccggaagctgccacctaatattgttctgaagagcagccgaagcagtttccac

SEQ ID NO: 435 - DNA, 99 bp, Artificial Sequence
  Affymetrix ID 3144603
caggaatgcaagcactgctacctaactaaagaccttggctttggaaacatcttaccccttggcagctctccagagtttagacttggcagcatcaaagac

SEQ ID NO: 436 - DNA, 153 bp, Artificial Sequence
  Affymetrix ID 3035937
agcactcctcccacgggcctgggaaggcaaatgtgttttctgaactgtgttgagaccgtgtgtgtgtgtgtgtgtgtgtgtgtgtgtgtgtgtgtgttggggtgtcttgtgaagtcctgctaacctcttgtcagcagaatattcgagaaatgc

SEQ ID NO: 437 - DNA, 165 bp, Artificial Sequence
  Affymetrix ID 3854106
cttcaaagtggagtagtggcacagagaccatatggcctgcagaatggaaaatgtcacctgtttggcctcttaccagaaaaatttgccaaccgctcaactagggtgtgatggagaatcccaaggtgtcccttccctcccaaagccactcagggaatcatctgtacc

SEQ ID NO: 438 - DNA, 67 bp, Artificial Sequence
  Affymetrix ID 2604179
ttgcaatggggagtgacgttcaacctgggacagaaatggaaatcgtagtagaagaaacaatatctgt

SEQ ID NO: 439 - DNA, 590 bp, Artificial Sequence
  Affymetrix ID 2625696
tagtgggacttttaagcatctctgaaataaaaaacttctttttacagacaagcattatagtttgagttacagacaacagtgtgtatatatgtaatatatatatagtaaaatgaaatttaaatatgaagccaaactttttaaaattagaaactacaaatggttatactgattagtgtctagcctagagtggtaaccatgctttactaattcagttatgaaatacattatttataatgcattagctgtattagctgttgcttttttgatgttcaggataactatgttatctcatttctgcatttaattaatagctcgagtattaaaagcccactcccttcaagaaaagctttgattttccccagtcatgaaagcccttgtttcaaattctttaatctctgaacctagtatcataagaatttcctcttttgataacatctgtactttcatattctgctcactatcaaatgtattgttaacacttagtaagtttgaaaatgaaggggttttatctgcatttgacattgaaccttgaagtactttaagtactccaaggggaaaattaaagtggaagtttcttcggatcttgttta

SEQ ID NO: 440 - DNA, 101 bp, Artificial Sequence
  Affymetrix ID 2410545
catgtggatgcggatgcctgaacaacgccggggccgagagtgcatcatccctgacgtttcccgatcctaccactttggcatcgtcggcctcaacatgaatg

SEQ ID NO: 441 - DNA, 138 bp, Artificial Sequence
  Affymetrix ID 2545098
atgtgtgtgcagaattctaggcagcaccttagggagggactgggatgagagaaagtgggacctggtgggctcaaccacacacacctgtctgtgcagatgctttgcccaggcttctcaccacggtgtaccgggatatta

SEQ ID NO: 442 - DNA, 27 bp, Artificial Sequence
  Affymetrix ID 2749561
atgctggtgccgctagccaagctgtcc

SEQ ID NO: 443 - DNA, 93 bp, Artificial Sequence
  Affymetrix ID 2849125
ttcttcggaccttgggagcagcaaaaagagccaatccaatggatacggagtccacgattgtcatgcgtgtactacgggacatgaatctttcta

SEQ ID NO: 444 - DNA, 85 bp, Artificial Sequence
  Affymetrix ID 3022356
gaacacctgcccaatgtcagctatacttcagctctcatttgcactattcaaacttataaagttgaagagcaacctacgcctgttg

SEQ ID NO: 445 - DNA, 42 bp, Artificial Sequence
  Affymetrix ID 2474026
gtggtagcagttttccagatgtggatgcttcatgatctggtg

SEQ ID NO: 446 - DNA, 25 bp, Artificial Sequence
  Affymetrix ID 3160004
tgctttgttgagggtgtaaggggaa

SEQ ID NO: 447 - DNA, 183 bp, Artificial Sequence
  Affymetrix ID 3795785
aatgggaatgaaatacatgcctttttgtttttaggggtgctcagttataaatatgaaaggctgagaaaatgctaattgtacagtaagatcaactggacttgttttaataagacaataatttgaaattagtaaactattttatacaaatagtgctaaaactttggaaggtcctcaacctcctgg

SEQ ID NO: 448 - DNA, 266 bp, Artificial Sequence
  Affymetrix ID 2990169
cttgggtatcacacaagcattactgacattgagttcatggaaaatacagaaaatatatacaaaattaatgccacagaacatgacaaatggctgtgaggggaggacttttgatcaattgcttgatcttaaacttactttagaagaggtggccagtgcctgccaattggctgccatgtggatacttcttatgcttgatcttaagtgcttttgtgtgtgacagctctacacaattccctagttaagagttacttctcaccaaccaaagg

SEQ ID NO: 449 - DNA, 34 bp, Artificial Sequence
  Affymetrix ID 3858632
gctgactgcagattcaaccttctgagctcacgaa

SEQ ID NO: 450 - DNA, 30 bp, Artificial Sequence
  Affymetrix ID 2481311
gctgagttgcaggggaagtaccagaagctg

SEQ ID NO: 451 - DNA, 41 bp, Artificial Sequence
  Affymetrix ID 3726479
tggccctggggctacgcaccgatgtggggatcactcaccag

SEQ ID NO: 452 - DNA, 365 bp, Artificial Sequence
  Affymetrix ID 3847164
ccatgcgaagtaccaagccctagttgttctccatccaggaggccgtgtggctcatcccttacccacagaccctcactcaccaccttcgtccctaccatccacagcacccgctggccctgaagtgattccttggtcctggacctggggttttgcattttgtctctgaggaggaggtcgcatggagggggaggggatggggatgtgggtgtatggacgggtggtgggtaggggcacgtctgatccactgtcacggcacctctggtgagttgtaatgcgttcgtgactccaactgactggtcttcacctaacctgcttatttctctgccaacacctgggatgggggtttgtaaatccagcagggctca

SEQ ID NO: 453 - DNA, 263 bp, Artificial Sequence
  Affymetrix ID 2945519
cttcccatgaccacacacaggagtggggaaaccttacttgtacttcatcggttttcttccaaatcagcgacgggagtaacatttttattcctatcaccaaaccacctgaaaaatggactcctaaacttcctcatatgacatcacattaggctaatcatgtaccctcaatatcatcagggtaagtgtatttattctgttattattacatttgtagtgcaagagctggacactctagaatcttccatgcacactactttgggagg

SEQ ID NO: 454 - DNA, 116 bp, Artificial Sequence
  Affymetrix ID 2960606
ctaaggctggatctccgtttctttccacctgctccaactgtacccacagctgtgtctgactggctgccgtcattatgctccagtgtgtacatctctccactgacactggtgctctt

SEQ ID NO: 455 - DNA, 27 bp, Artificial Sequence
  Affymetrix ID 3275073
gaggaggttgactcaggagaacttggg

SEQ ID NO: 456 - DNA, 595 bp, Artificial Sequence
  Affymetrix ID 3392454
gatgctgaattgaactgggatcttcttgtctgtcaagcccttgaacagctttccctttaagcaacaaagatgacaagtttttgctattttggattagtgagagtgtacgaaatggtttccctttccttccaggcaaaaataccaacagaatctggcttcggaatgaaagtgctaatttcatttggtgactttcagatttgaaatacgggcttgaacaggcattgtgcattagtcagctgaggcagtggaggttatttttacgatgctaattattatttcctgacagtgatttactttatgttgtctactgtttacgcccccaaactagccattgttttaggaacagaattggttgggttgtcatgctcttttcaaagacaaatcttactattttatgcatagaaatactttcctgtaataaagaagaaagctttattgaagagaatcttgcatatgaaatgtaatctggataaatattcaaaactaataggtttatattttagtcttgatttttaaagtatatttttctgacatcctaaccaccttgctttatgtgcattaaagttaaatctgttttactgggatgcggctgaat

SEQ ID NO: 457 - DNA, 88 bp, Artificial Sequence
  Affymetrix ID 3428624
catttgagatgcagatcatcaaggccaaagataactttgcaggaaattacagatgcgaggtcacctataaggataagtttgacagctg

SEQ ID NO: 458 - DNA, 147 bp, Artificial Sequence
  Affymetrix ID 3869530
ccattacagcagcaggatccagtgacccgggatgctcacatctctccctgacgtgggcggagtagccccttcctcccaaggtcactgtcctgtccaaccccgtgctcccctagcccgttgggaggtggacagtgagacatcttccca

SEQ ID NO: 459 - DNA, 163 bp, Artificial Sequence
  Affymetrix ID 3180781
tattgggagtcctgtcagaagctgcctgctacagggtctttagctttccttagattttcaaagaggtttgtgatccaagaagaatagagttttgaatctagattttatactaaacgatcactttagattttcaggagtgtgtgcctagtttgtgattaagtta

SEQ ID NO: 460 - DNA, 78 bp, Artificial Sequence
  Affymetrix ID 3319155
ccacagtgctgctagtaatgaaacctaccaggaacgcttggcacgtctagaaggggataaggagtccctcatattgca

SEQ ID NO: 461 - DNA, 119 bp, Artificial Sequence
  Affymetrix ID 3428631
cttgatcctgcatatcaggttgacaaaggaggcagagtgaggtttgttgtggagctggcagatccaaagttggaggtgaaatggtataaaaatggtcaagaaattcgacccagtaccaa

SEQ ID NO: 462 - DNA, 121 bp, Artificial Sequence
  Affymetrix ID 3435265
agccgaaagccgtgattccgatctacgaaggcgattaccaccctgagcccctgaccgtagaggtgcagatccagctgaaccagtgccgctcggcggaggaggctctgcgcatgttcgccgt

SEQ ID NO: 463 - DNA, 31 bp, Artificial Sequence
  Affymetrix ID 3697431
ggaaagcggggcagacaaagtatccaaaagt

SEQ ID NO: 464 - DNA, 510 bp, Artificial Sequence
  Affymetrix ID 3928125
gggcactcacccaagtaatgtccaaacaatatttttccatgtcccccctcccccagaacacacacaggcaaaggcagagatgtttactgtgaggtcacatggcatgaagcaaatgcagccttatctgtttattattacaacagccagttagcattggcaaatgtgctttggttacaaacatggtttctgctaataatttcatgaagaagcttttaggatatgtgaccatttattcttagtataatcaatcattgaaggataaaaatcagagtataaaagtttatactctggcaaatataaatacatgcacagaagtttctgacagtttaaatttgagcatatttgaaatattaaaggcatgaaatttaaaaatacacatacgtgaaactatggtgaacatgttatgggtttgtcccatggtttaactctgctcagcccacgattcttagctgggtcagtcaatagtctatttttatcattttctaccctgttgtacagcatgatcatatc

SEQ ID NO: 465 - DNA, 26 bp, Artificial Sequence
  Affymetrix ID 2769166
gtggggtcagagaagatattaggaaa

SEQ ID NO: 466 - DNA, 106 bp, Artificial Sequence
  Affymetrix ID 3545551
tggcgcatatcagcagacggcggtcactactgtggctcatttaaatctgtgttcagctccgggcctcttttttcaggaatccttgtttcgggacacccagtggaca

SEQ ID NO: 467 - DNA, 207 bp, Artificial Sequence
  Affymetrix ID 3899443
gacttacctggagagcgcgagaactggtgtagcttacgtggagtgagaagagatggggaacatgtgaatgaggtcagagcggttgcaggaaacggactgctgctgtaggccattttaaagacttttgattttcctctgaactgccgagtattttcagcagaggagtaacatgatctcacttatttttaacgggcttactctggctgc

SEQ ID NO: 468 - DNA, 26 bp, Artificial Sequence
  Affymetrix ID 3182036
aagattgaggagaagagtagtgacaa

SEQ ID NO: 469 - DNA, 95 bp, Artificial Sequence
  Affymetrix ID 3063084
gagctgggtacagagtgcttcatgctgagcctccgggcatgcttcgtgtacactccgcacactctccacacacacacgttacatggcagcagtcc

SEQ ID NO: 470 - DNA, 393 bp, Artificial Sequence
  Affymetrix ID 3387617
gaaagcctgtgtatcgccgtgactccgggcgcgagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcga

SEQ ID NO: 471 - DNA, 123 bp, Artificial Sequence
  Affymetrix ID 3566496
cctaagtcacgcctctggaactttggcaagttctatagaagagtcagcagcaggtgtgggtcaaggtcccaattcacttcctgcagctgtaccatcccttcctcgttctgcaaattttctcta

SEQ ID NO: 472 - DNA, 26 bp, Artificial Sequence
  Affymetrix ID 3088581
tgatctcatgatctcaaaacaaaggg

SEQ ID NO: 473 - DNA, 107 bp, Artificial Sequence
  Affymetrix ID 3120740
gagcttggtttttggtcagaagccaagaaaaaagatcggagaagaaaagaaggaatgacctcaacttgctctgcacggaggacggggacggctcagagataaatagc

SEQ ID NO: 474 - DNA, 67 bp, Artificial Sequence
  Affymetrix ID 3399570
cctggacgccagtgagttactctcagacacgtttgaggtcctcagctcaaaggagatcaagcttttg

SEQ ID NO: 475 - DNA, 156 bp, Artificial Sequence
  Affymetrix ID 4010188
tgtatcaaagtaatgtgtccaccggtgtgagcaccagcaactcacttcttcctcagacatctctaaagctggaaagattttgagggacaatatggtttccttcaccccacaccaatgttatgaatgagaccagcagaccaacagcaaacacctaga

SEQ ID NO: 476 - DNA, 36 bp, Artificial Sequence
  Affymetrix ID 2638236
tcagctctgcagccctacagttaccagctaaccttg

SEQ ID NO: 477 - DNA, 230 bp, Artificial Sequence
  Affymetrix ID 3683253
tgaatgaatatggtccctggggctaaaagtaagaaaggagaaaaaaataaagcaacccccaaatttgatgagaaccctatagtccctgactgattgtttcctggccatcatcatcatcagcttcaactttgtcaacacacccttaatatgggtgtaccttgttttacagtttgccgagcactttcacacccattattggatatgacacacaacccggtgagagtgctctc

SEQ ID NO: 478 - DNA, 123 bp, Artificial Sequence
  Affymetrix ID 2502720
ttcacttctctgctcccgaggtgtcctcgggctcatatgtgggaaggcagaggatctctgaggagttccctggggacaactgagcagcctctggagaggggccattaataaagctcaacatca

SEQ ID NO: 479 - DNA, 25 bp, Artificial Sequence
  Affymetrix ID 3378495
aaaactgccctggaggatcggcacg

SEQ ID NO: 480 - DNA, 26 bp, Artificial Sequence
  Affymetrix ID 2642712
atcattttgctcaggccacggccact

SEQ ID NO: 481 - DNA, 55 bp, Artificial Sequence
  Affymetrix ID 2798891
catttcccagtgctgtatactcctatctcccagtgctgtttgctcccatttccca

SEQ ID NO: 482 - DNA, 32 bp, Artificial Sequence
  Affymetrix ID 3428610
agagaaggaggccggaactacaccagcaaaag

SEQ ID NO: 483 - DNA, 26 bp, Artificial Sequence
  Affymetrix ID 3691119
ggtctcgcgcgccgtcttctcgagag

SEQ ID NO: 484 - DNA, 61 bp, Artificial Sequence
  Affymetrix ID 3821139
agaccattgtgatgattcccgactcccagaagctcctgcgatgtgaacttgagtcactcaa

SEQ ID NO: 485 - DNA, 119 bp, Artificial Sequence
  Affymetrix ID 2349300
gagaattgggaatcaagaatcagccctgtttccatcttagccacaccaacttatatctttatgattttcaaagcttttgccatgtgattctgcccccacaaaggcatcggtatttccta

SEQ ID NO: 486 - DNA, 414 bp, Artificial Sequence
  Affymetrix ID 2638933
tgcggatctccaaagcctagggatttttccgtaaaagagagtgggccgttctggttacccttttattagaagggtattccaccacagagagccggaggttttccagatgtgtgtaagagagcaggtgcgcaaggcaagcaaatgagcgcaaacagtattatggaaaacatttgagaagttagctccatgaggactgtgggctccacaagaggactcgactgggtagcctggtctgacacaggtacgtgaaagcagagtattgcttcaaagctggaaaccttccataggagcctcacactgttggaagatgtactgctgctggttaaggtcaacctggggtgcaatgctgctgtcttcatcttcggtcccgaagtaatgctcaataagatcaaaggccttttggtagatctcctg

SEQ ID NO: 487 - DNA, 70 bp, Artificial Sequence
  Affymetrix ID 2661085
ttcctcacaaactggccttccatttccagcagaggcaaatcaaattgccctttccgccctcatctctttg

SEQ ID NO: 488 - DNA, 29 bp, Artificial Sequence
  Affymetrix ID 3037551
ggcagtgaggagatcggtaacttgggagt

SEQ ID NO: 489 - DNA, 76 bp, Artificial Sequence
  Affymetrix ID 3215176
tggccgtctgtacagaacccacctgcaaccaccacaccctgagcccatgtggccgtctcacctctaagtcacccaa

SEQ ID NO: 490 - DNA, 57 bp, Artificial Sequence
  Affymetrix ID 3410744
gcattacaaggagccagtcaaattattgctgaaatccgggagactcatctttggtga

SEQ ID NO: 491 - DNA, 26 bp, Artificial Sequence
  Affymetrix ID 3439960
cagagcgccagcaagcggccacagaa

SEQ ID NO: 492 - DNA, 38 bp, Artificial Sequence
  Affymetrix ID 3461262
tcattttaactctgtgcagagtatcaaatccatccatt

SEQ ID NO: 493 - DNA, 26 bp, Artificial Sequence
  Affymetrix ID 2316284
atgccaacgccgacgtccctgcgggg

SEQ ID NO: 494 - DNA, 27 bp, Artificial Sequence
  Affymetrix ID 3882865
tcctagcagcacacatatgcagctctt

SEQ ID NO: 495 - DNA, 194 bp, Artificial Sequence
  Affymetrix ID 3685651
aggggagcttcgtgatcctgtgcaccaagtctccatgccccttgttgtacccagagcaccatgctccccgccagccccctgtccacccctgcttagttatacagccattgtccgttttgtgtagaacagtggctttcaagcttttgtcaccatgatccatattttaaattgcaaccctgttccctatgatacct

SEQ ID NO: 496 - DNA, 116 bp, Artificial Sequence
  Affymetrix ID 2854135
ccgaggactgttgaattgtggaacatctggtggaaaatagcaagaggtgacagaaatgctaatggggcagtgagatgtagacttcaggcagaattgttgtacctgtcgagttggag

SEQ ID NO: 497 - DNA, 143 bp, Artificial Sequence
  Affymetrix ID 3314277
gtctaaggaaaacaacaggctgcgcgaaatcagccctcagggtaacactgaacctggcgctcttccggcaccacacaggaggcgacgcccgggaaagaagactgagcggctcctgtctgaagacgtctccatcagtccagcca

SEQ ID NO: 498 - DNA, 30 bp, Artificial Sequence
  Affymetrix ID 3724236
tgatggcgtggagcagctaaacaacatcct

SEQ ID NO: 499 - DNA, 121 bp, Artificial Sequence
  Affymetrix ID 3746906
cacaggtatgaaacacctagcgatgctattgaggtgataagtcctgccagctcacctgcgccaccccaggagaaactgcagacctatcagccagaggttgttaaggcaaatcaagcggaaa

SEQ ID NO: 500 - DNA, 63 bp, Artificial Sequence
  Affymetrix ID 3909730
gaccttcttcagattcgatcgtatgtgtacgcagaagagccaaatattgacattcacaacttc

SEQ ID NO: 501 - DNA, 136 bp, Artificial Sequence
  Affymetrix ID 3428460
ttggttgtacagttggcacgagatctgcagatggatttctacccacactttccagagttttttttgactatcacctcgatcctggagactcaggacacagagttgttagaatgggctttcacctcgttatcatatc

SEQ ID NO: 502 - DNA, 74 bp, Artificial Sequence
  Affymetrix ID 2751975
gggattatttgccattgaacgagagttcttctttgaattgggtctctatgatccaggtctccagatttggggtg

SEQ ID NO: 503 - DNA, 261 bp, Artificial Sequence
  Affymetrix ID 3894100
tcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgatta

SEQ ID NO: 504 - DNA, 242 bp, Artificial Sequence
  Affymetrix ID 3908236
accttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccggaaggagattctcatttggctgcagagtgtcgcaca

SEQ ID NO: 505 - DNA, 189 bp, Artificial Sequence
  Affymetrix ID 2407923
gaggtctcccgtcactgggcatccagctgggtgctacggccgtggctcctgccttctgcagccctgtcagggcccaaggccttcctcatcagcacttgctccagcctactcactggagttgtgttctgggtgggtgtgtagaatactcgcactcctacttggggcatcagggagctctctagcaatttc

SEQ ID NO: 506 - DNA, 285 bp, Artificial Sequence
  Affymetrix ID 2571603
ttggaagctaacctgccacattgacttaactgagtgaccccagttccaaggcagggcctctacaatttccagtttatctattgtttcctgtgtaagagcagatacttactgtaagtccgtaagtgctactcgtaggtcaaacaaccttgatgatatcacacttcaattgtcttataaatcccatctgaaccactcctaccctatggtatatgagccctgggtttgggtgctaatgcggggatccaccatctcatctcattgccgcctgagacacctacatggctt

SEQ ID NO: 507 - DNA, 28 bp, Artificial Sequence
  Affymetrix ID 3634205
agcagatgtcagcatccgggtcacctag

SEQ ID NO: 508 - DNA, 53 bp, Artificial Sequence
  Affymetrix ID 3746967
ccactgtataaccagccatcagataccaaggtgtaccatgagaacatcaagac

SEQ ID NO: 509 - DNA, 65 bp, Artificial Sequence
  Affymetrix ID 3675286
ccgcctggtcttgtgcccgagacgggcggaggctggaacttgagacctcaataaaggaagtagag

SEQ ID NO: 510 - DNA, 89 bp, Artificial Sequence
  Affymetrix ID 3809651
agctggcaccattcatcgccaaacgccgaacccccaagattcaagagcagtaccgcaggattggaggcggatcccccatcaagatatgg

SEQ ID NO: 511 - DNA, 58 bp, Artificial Sequence
  Affymetrix ID 2793478
catattgagcagaggaccaaaatcgatgatctccttggctggtggcttaccaaatcca

SEQ ID NO: 512 - DNA, 850 bp, Artificial Sequence
  Affymetrix ID 3139792
tgtgtcacttctgcattgcccagtattttgagttgggggaaaaatgaactcacctggccccacctcctgttccagtgtgaaatactgacacttgctgccagcccagcctcctcacataagcattagaaatatcagacagtccactaggttagagcacctcattcatgaggttctgttatttattcggctctcccactaaaatgcagggcataaatttatgtgtctgctctaagactgcagctgtctgccccccctccaccctcctcctgcccttcctgtgtcagtgttacattcgctccccccacttttggtctcaggtctgtctcctttttgtttttatgggtgatttgcagtgattcagacagggcatccttgcatgttggcacttcctggaggttaccaggaggcagccatccttccttggcttggccaggcatccccgactccaccccactttccccttggtggtggaaaggtgggttggaggtgtgtactggggcacatagcccaggaatgttgctctgagaagaggacatgtgcagtagacacaaaaatataaggaagcaattatgttcatcaagccgaaagttgcagattttgaggaaatgtgtttaagataccactacataataaaagggaaaaccacttggcatttaaataacttacttcaagaggaaattatgatattttcagtctacaaatagagtggtttttaagccaaccttgagtaggtacaagcaaattataaacagtctgctcaaatgattttactatacttagactagaaaatggctcctcttctctctccctctggtccctatgtcccagtgctgtccctcatatgttacaa

SEQ ID NO: 513 - DNA, 37 bp, Artificial Sequence
  Affymetrix ID 3296171
acatggctctggtcgaaatgtgactgaagctttgcat

SEQ ID NO: 514 - DNA, 25 bp, Artificial Sequence
  Affymetrix ID 3470058
cttatttagctgacagaccacctcc

SEQ ID NO: 515 - DNA, 84 bp, Artificial Sequence
  Affymetrix ID 2830812
tgggtaacagaacgcaactttgtctccaaaaaataaataaataaattgttacaatgaaagtggctctgtgttagccgggagtgg

SEQ ID NO: 516 - DNA, 71 bp, Artificial Sequence
  Affymetrix ID 3151504
cttagggaatctgtttcggtggctcagagaaggatctgttgccaatcagccgatgccaggtctccggtgct

SEQ ID NO: 517 - DNA, 41 bp, Artificial Sequence
  Affymetrix ID 2978822
ggcaggtccaggaactgggtctggagccttgaaagcagaag

SEQ ID NO: 518 - DNA, 76 bp, Artificial Sequence
  Affymetrix ID 3432174
gtgcgatggaaaaggtatccaaagtgatactccctttgactctgagcatcagttgcccgtgtttcagtcacttcaa

SEQ ID NO: 519 - DNA, 78 bp, Artificial Sequence
  Affymetrix ID 3922854
gaccaactgcccctgtaagtacagttttttggataaccacaagaagttgactcctcgacgcgatgttcccacttaccc

SEQ ID NO: 520 - DNA, 232 bp, Artificial Sequence
  Affymetrix ID 3225896
ctggatctgccacctcttctttcggctgtggatggccctgggagacacgcctggcctcagatgccccttgacccaactggaggaagggtggggggcccagcagaaaagcctgcagcctccctgggcaccgtttcaaagctgatgctgctctccctgctctgggtctcagctcctcccctcttctgcattgttgaccaacagcctgggtctgacgcggaagcagaagaattcc

SEQ ID NO: 521 - DNA, 98 bp, Artificial Sequence
  Affymetrix ID 3981141
aatcacgcagtggtgcacggcaacctggcttgtgtatactatgagcaaggcctgatagatctggcaatagacacctacaggcgggctatcgaactaca

SEQ ID NO: 522 - DNA, 381 bp, Artificial Sequence
  Affymetrix ID 3040366
cctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcata

SEQ ID NO: 523 - DNA, 33 bp, Artificial Sequence
  Affymetrix ID 3847114
gagtaccagttctgttaccaggcggcactggag

SEQ ID NO: 524 - DNA, 60 bp, Artificial Sequence
  Affymetrix ID 3903914
aattccagagaagggtttgagtttggagttttatctgttgtaaaatggccctgcttttag

SEQ ID NO: 525 - DNA, 53 bp, Artificial Sequence
  Affymetrix ID 2545695
attcattatattgacgctggttaccttggtttcaaggcctacttcactgctcc

SEQ ID NO: 526 - DNA, 186 bp, Artificial Sequence
  Affymetrix ID 2468742
ggaggttcgttcataacacaccctagaaaccatgaaaaacatggagagccaagtggagtgagtgacccgagtttacaaagcctgcaatgatcattcttttattacctgacaggatttagggtaactagaaaaacaaatacaacttatcttaggcaatcacttctctatgatctcagggaggctata

SEQ ID NO: 527 - DNA, 221 bp, Artificial Sequence
  Affymetrix ID 3332623
ctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagct

SEQ ID NO: 528 - DNA, 107 bp, Artificial Sequence
  Affymetrix ID 3457669
ggctttatcggatagggacagacgaggtaaggaaggttgtttaatgagaggccttgcttgccagcctaagcttttaaatttgatgccagtggcaacaataaagtgta

SEQ ID NO: 529 - DNA, 35 bp, Artificial Sequence
  Affymetrix ID 3575429
gtggcagagatggttgtattcgtctttgggattta

SEQ ID NO: 530 - DNA, 29 bp, Artificial Sequence
  Affymetrix ID 3676065
atgggggacgaatgccggctggattcaag

SEQ ID NO: 531 - DNA, 496 bp, Artificial Sequence
  Affymetrix ID 3541353
gggccctgcccagataaaattgttggtcttgtctgtaattagtattccaaaggttcaggtggtgttgcatctccgtatcaatgttcagctagtaggtaaagggacatatttggagggaactaactctggcctagctactattatgctcttcactttttcttttttattctctcaagccccagcatcatgcagtcctcagttgggtgcttacgtgctcttctcttccttgcagcagtcctcaaggcagggcagattcctctttaaggtgctcgcatgttacccctgggttctgctgacccaacattagctacaaagtgggacagtcccacagtgctccctcttccttgttgtggggaagaccgcaaaaagacctcttttgctttagtgactttgttcctactcaatacaggaagtgttgaccagcaaaaataataattacaaaggctaagttctgatttattgttcctgactcccgtgtgattaactggaaaccctg

SEQ ID NO: 532 - DNA, 179 bp, Artificial Sequence
  Affymetrix ID 2428388
tggagctctccaaattaagaatgggtagtgacaaactttgaacaggtaacaaacaataaattcaaagtatatttaggattaaacagtcaatttctaaatgggagtctatcatgtctcccctttgcaatactggcttcccaacaggaattctatacttgtccagtccaccataatgggta

SEQ ID NO: 533 - DNA, 26 bp, Artificial Sequence
  Affymetrix ID 2883068
tttctatctcttcaccttacacacac

SEQ ID NO: 534 - DNA, 77 bp, Artificial Sequence
  Affymetrix ID 3686201
agggctcgattccagcttctacggacacctcaagcgcaactggatctggaccagctacatcatcaaccaggccaaaa

SEQ ID NO: 535 - DNA, 35 bp, Artificial Sequence
  Affymetrix ID 2933137
atgagcaaggctggtatctggagttttgataaagt

SEQ ID NO: 536 - DNA, 76 bp, Artificial Sequence
  Affymetrix ID 3098268
agcctcagattctaccgaggcaggcgccccaaataccctccggacgctggcagcagttgcgtgcttcatctgtcct

SEQ ID NO: 537 - DNA, 122 bp, Artificial Sequence
  Affymetrix ID 3804158
cagtgtgccattgtaatttattggtggagtgctatcattggtaacaatatcatataaatgtatttaacccctcctagcttttgaagtaagattcatgttagagctagaatttgtctgggtgc

SEQ ID NO: 538 - DNA, 34 bp, Artificial Sequence
  Affymetrix ID 3570485
tggaggggcaggattacacactgaatcattggca

SEQ ID NO: 539 - DNA, 286 bp, Artificial Sequence
  Affymetrix ID 3666058
ctcttggcttcaagtgattgatcctcccacctcagcctcccaaaatgctggaattacagacgtgagccactgtgcccagccagctcatcttcgaataataacagttttacttcttccttcttaatttttatactttttcccccctttttcttgcttcattgtattgactaggatttctgatacattgttgattagaggtggtgatggaggacatccttgtctttttcccaaactcagggcaaaaaaggattcatagttgtgccattaagtaatttgctagggtttg

SEQ ID NO: 540 - DNA, 101 bp, Artificial Sequence
  Affymetrix ID 3692317
acaatgtggctgtgtttgatcccgcgacgtgtcacttggaatctcaatttattgccaatagacgacgttgtcaggcactaattttctggtggcgctccatc

SEQ ID NO: 541 - DNA, 104 bp, Artificial Sequence
  Affymetrix ID 3749798
tcgggggtcacaagccaaagccacaccgctagaagggctcaggacccagcccagctcccgtcctcttggtggcatcaagcttgtgtgatatgaggtcttatgtc

SEQ ID NO: 542 - DNA, 147 bp, Artificial Sequence
  Affymetrix ID 3965785
atggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaata

SEQ ID NO: 543 - DNA, 314 bp, Artificial Sequence
  Affymetrix ID 4051547
tgaccttggcccagaatccaccagggcagggcctgtgaacagggccaacttggggccctcctccgccctctctggatgcctccccttcagcactgggcctgccaggcagacagatggacacgtgcttgaggaaacacgggttttatctgggcgaggggttcacgcctgtgctccggggcccctgcccaggttgtgccgggttcagagttgactggctgccagtggaacagagtgtactttgctaatgaagcccttgtcattggacagataggctcctccaggtcctccctgccctgtaataaacgttgccaccg

SEQ ID NO: 544 - DNA, 108 bp, Artificial Sequence
  Affymetrix ID 2849256
aagacaggctggtgctttcaaaatcagtattttattgtgaggtcaagcagaaatgtactagcagcacaaccacagatgacacttgtttggcttaaaacaagacacaca

SEQ ID NO: 545 - DNA, 78 bp, Artificial Sequence
  Affymetrix ID 3166772
tttcttgtctcttgagtggcggatcatgcgacacctcccgaccacagcatttgggcgagatatagacatgcctctaaa

SEQ ID NO: 546 - DNA, 102 bp, Artificial Sequence
  Affymetrix ID 3886907
acaacgagacattagaggtgcacccacccccgaccactacatatcaggacgtcatcctaggcactcggaagacctatgccatctatgacttgcttgacaccg

SEQ ID NO: 547 - DNA, 78 bp, Artificial Sequence
  Affymetrix ID 2474079
agggcacagagagttcaacaaacactgaaacttaagtttgtcctggacatcttcagcatccgactttctggtggaaag

SEQ ID NO: 548 - DNA, 25 bp, Artificial Sequence
  Affymetrix ID 2661946
gccatcttcctatcctggtcctgat

SEQ ID NO: 549 - DNA, 312 bp, Artificial Sequence
  Affymetrix ID 2963039
ttggtctctatctgggcacagtctctttggtactgtgtgttaggactagatgtttttaacatgaatgaaaacgtggactcaaaagaaacacttttcaggtgtctataaatcttcttattttcaagtttacttagtatttggtcctggggtgtctacatgtcactcagttttgaggaaaaaatgagatgaccttagaaataacatagaaattaatgtgattgatgaatatccttagaaatttaatgagatttatacttggaatatggcaattacaatattttattgaaaaatgaataggtcaccagcctggcc

SEQ ID NO: 550 - DNA, 280 bp, Artificial Sequence
  Affymetrix ID 2991676
tgaatgcatttagacaccggatctatttgcattttaccatgggtcctcaataaataaatagaatgttgttttttgtattttaagtttttttttgtttttcccctcagaggaaggatgaaaaaaagaattaactgactatggttttgcaggccagtttgatcccagtatttttatttctaaaggtgttcttatagttcctctgattgttaccattttaaaatagagaaagtccatagtgatgcctttcctttcagtggctgattggcacgacctcttgaga

SEQ ID NO: 551 - DNA, 479 bp, Artificial Sequence
  Affymetrix ID 3535849
ctgaatgctacaacctcggagagagaataggggagtgttggtgtttgtggtgaatcggaaagcacgtgtttaaagaggacaatcacattaattcagttccagctatgagattacattgtcaaatcatctgatttttcaagagaaatcacaaatttgaatttcttaaaatgagaaatctactttttaaataatgacgggattttcaagtatgttaaaaatactgtaggctaataccgaataagctaagcaaaacttttgtggatcaaaccgaaaccatgggctattttcttctcctcctcttcctcctccttctcataggaataaaacaactaaatataatcctgtctttataatttccatataccaagctttaattatatttaatacccatcaaagttagttaaaatgaactctgagtaatttataccttatggaaaaattacggtgttctaagtctgaccaaatgtgtagaaagtacc

SEQ ID NO: 552 - DNA, 114 bp, Artificial Sequence
  Affymetrix ID 2488753
agccagctatggtgcggatcaatgcgctgacagcagcctctgaggctgcgtgcctgatcgtgtctgtagatgaaaccatcaagaacccccgctcgactgtggatgctcccacag

SEQ ID NO: 553 - DNA, 100 bp, Artificial Sequence
  Affymetrix ID 2575232
gtgatgtccagttctaaagtaaccacagtcctgaggccgacctcacagctgccaaatgctgctactgctcagccagcagtacagcacatcattcaccaac

SEQ ID NO: 554 - DNA, 27 bp, Artificial Sequence
  Affymetrix ID 3076375
cacgccaagtcaatcatccacagagac

SEQ ID NO: 555 - DNA, 125 bp, Artificial Sequence
  Affymetrix ID 3187656
aatttgcagcagatatcccagcagcagaaaggggaaatagagtggcagaagcagctccttgagagggataaacgagaaatagaacgaatgactgctgagtcccgagctttacaatcgtgtgttga

SEQ ID NO: 556 - DNA, 30 bp, Artificial Sequence
  Affymetrix ID 3286398
actgaagcccaccacaaatatgaccactct

SEQ ID NO: 557 - DNA, 36 bp, Artificial Sequence
  Affymetrix ID 3840338
acagatgtcggccactttcgccatcctgttttttgt

SEQ ID NO: 558 - DNA, 59 bp, Artificial Sequence
  Affymetrix ID 4019888
ggaacagagtgtgccagaaccctcagggtgtttctcagctcttgtttacgggccaccag

SEQ ID NO: 559 - DNA, 124 bp, Artificial Sequence
  Affymetrix ID 3831504
tggtttgcgaatatgctcaagtctctggatgaattgtatgacagtgaaggggtatgtgattagactgttgtggctttgaggttgatgtgtatgttttaaaggattatgattgagttggagatca

SEQ ID NO: 560 - DNA, 270 bp, Artificial Sequence
  Affymetrix ID 2540638
ctccttctatcccaatcggacagtgatatgaccctggggatgttccatgaatcatttgttcctctttggccccatctgattgtgtacttatctccttacacagtccttctgaccttgaaatgatccagaaaagatgtaaaagagtaaattctatagtcagtttaaaaggcagcaggaaaggattgggaagcattttggacaaggggtctaggagacaggcccagctctgcacttttccgtgggacaaaggcctttgcattctctcctgta

SEQ ID NO: 561 - DNA, 70 bp, Artificial Sequence
  Affymetrix ID 3229612
acgaggatgagcgtgtggacgaggctgccctgcggcagctcacggagatgggctttccggagaacagagc

SEQ ID NO: 562 - DNA, 149 bp, Artificial Sequence
  Affymetrix ID 3839570
ctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaa

SEQ ID NO: 563 - DNA, 134 bp, Artificial Sequence
  Affymetrix ID 2380069
ggcagcaagtgtttacgagcccatatttggattggactatcgaacgagtagctttaaatgcaaaggtggttggagggccacatggagacaaagacaaaatggttgctgttgcctcagagagtagcatcatcttg

SEQ ID NO: 564 - DNA, 42 bp, Artificial Sequence
  Affymetrix ID 3428646
tctgattgacaagacgaagttcaccatcacaggtctgccaac

SEQ ID NO: 565 - DNA, 903 bp, Artificial Sequence
  Affymetrix ID 2998434
agtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttacc

SEQ ID NO: 566 - DNA, 28 bp, Artificial Sequence
  Affymetrix ID 3544955
gctttctcctcttccgggtcttggactg

SEQ ID NO: 567 - DNA, 48 bp, Artificial Sequence
  Affymetrix ID 2981913
cagctaagatgccatgtgcaggtggattccatgccgcagacatgaaat

SEQ ID NO: 568 - DNA, 391 bp, Artificial Sequence
  Affymetrix ID 3013230
agactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaa

SEQ ID NO: 569 - DNA, 27 bp, Artificial Sequence
  Affymetrix ID 3739279
gtggcagtatctgtgacgatgggaagt

SEQ ID NO: 570 - DNA, 156 bp, Artificial Sequence
  Affymetrix ID 2409084
agattttttgccactgccttgaggatccctgattcctattgattttacctgcccttggacctgtccacctctatcttcacctccacctccctgatccggtctctaatcaactctcacctggacaacagaaatggcagcccaaattgtctcccacat

SEQ ID NO: 571 - DNA, 717 bp, Artificial Sequence
  Affymetrix ID 2848243
tccacaggactagctggcagatctaacgttggggagagagacaaaggtggggtcacaggcagccccagcgtgttggcccaagttactggaagtttggagttgccttgggaagtggaagcttgtgtctagcaccttagaccaccgggccatcctgccacacgcttggagttgctttgaactatgctggggaaggtgcaggcggagctggctgggaaagtcagcatgggcatgtgaagtttgggtgtacatgacatcaggctggcagtggtgggtgagaaggagtctggggttcgggccagagggtgggctggagatgtaggtttgttgggcatccgcacagatggagcctgggagtagctgagactccatggggagcacgaggatgagctgttgaaggcatgagctctggaccctggcattagaggtctaggaaattaggggcaaccagtaggacttgagaggggagcctggggaggaggaagtgccaggagtgagttacactggcggcccagtgaaaccggggttcctggggggcgggatgtgtgtgtgtggcagggctgggttatcttatacctttcagaactatgtttaaagttttgtagatgtaattagaataggatgagttcatgccactttgaaacctataattgtatgaataattttgaattcctttacgcagacatgacacatcacggcttctctttgcgtatgatatca

SEQ ID NO: 572 - DNA, 107 bp, Artificial Sequence
  Affymetrix ID 3775781
tgactgagctgtggaccgcaagcagtggcagccccttggctgctcgctattttgagtctggagagattgttcacgaggagcacaggctgtttggcaacatcagagct

SEQ ID NO: 573 - DNA, 580 bp, Artificial Sequence
  Affymetrix ID 3990538
ctgggtagtctacgagaaatgtcaattattatctctactacaactacttacatatatctaatgggaaaagagtggggcttaggtgtcagagtggatgggagacaaaggagaagctacactaataaatacaacaagtggaaggtacctgtcccattcctaaaaggatttgtgggcaatgctggcacttggtggccaggagaatcttctgaccccactctccctcctcttcagtcctgaagaccccaagaacccagttaggatcccctggccagaggtctctgtgactgcctctggactcagcacgtgcagcagcttgggaggatttgagccagtctcaaaaacttttagccccagaatgagaccagtgaccccaagcaggagggctgggatctggagggaagagagggggtccaaggggaccctgtggctgaggccatggagaaccagtgccagggcccaagagacccatttttccagttatcagaggtgactgacatcttctgccactgccttgagttcagaaatttaaaaaagcttgcagcaagaaaatgccagtgtgcaactgggtgactaaagacca

SEQ ID NO: 574 - DNA, 290 bp, Artificial Sequence
  Affymetrix ID 2411004
ggactgacgcgttcccactttcttactctgcacctccccactctcttcccattcaagaacgagtttctcttccctctccattggaaatcttgctccggaggtccgaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccag

SEQ ID NO: 575 - DNA, 162 bp, Artificial Sequence
  Affymetrix ID 2642748
acaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaatt

SEQ ID NO: 576 - DNA, 25 bp, Artificial Sequence
  Affymetrix ID 2661956
atggacacccactttccatgcttag

SEQ ID NO: 577 - DNA, 42 bp, Artificial Sequence
  Affymetrix ID 3307945
aaaatccagtcccaactgcagatccctatgcactcccccaac

SEQ ID NO: 578 - DNA, 203 bp, Artificial Sequence
  Affymetrix ID 3789999
ctctcttcttgtggtaggtcccagaaacttctacttgggggtacatgaggcccagctgggattgggcacagaaggtcatggctctgcacctgaccctcaccttaggggtcaggagagagccaaggacacgagtgatgggttagggaggactcaggcaccatggaatactgtggccatccttccatagaggagaggtacaggtg

SEQ ID NO: 579 - DNA, 93 bp, Artificial Sequence
  Affymetrix ID 3963093
atggcgattataccagactggcttaggtcgcatcctcacacacgaaaatttacacattcaagaccccattcttcaccgtgtagagtatattca

SEQ ID NO: 580 - DNA, 25 bp, Artificial Sequence
  Affymetrix ID 3589632
cagagaagctgacgaggagagaagt

SEQ ID NO: 581 - DNA, 88 bp, Artificial Sequence
  Affymetrix ID 3816037
tttccatcacccagcaaacgccgtcccgcagcacccgggaagctgcggagtcgggctggggccgccgcgttgcgcacatcggtccttg

SEQ ID NO: 582 - DNA, 121 bp, Artificial Sequence
  Affymetrix ID 3417925
cggtgaattcctcttgccgagcacaagatgagtttgagtgtgccaatggcgagtgcatcaacttcagcctgacctgcgacggcgtcccccactgcaaggacaagtccgatgagaagccatc

SEQ ID NO: 583 - DNA, 72 bp, Artificial Sequence
  Affymetrix ID 3696235
acccgctgatgactacaccagtctgatgcctgttggtgacccacctcgcactgtgttacaagcccccaagga

SEQ ID NO: 584 - DNA, 62 bp, Artificial Sequence
  Affymetrix ID 3462998
aagaagcttatccaacgccaaccaaagatttgcatcagccatctcttagtccagcaagtcct

SEQ ID NO: 585 - DNA, 51 bp, Artificial Sequence
  Affymetrix ID 3962740
ctttgaatgctatggctacgacatcatcatcgacgacaagctgaagccctg

SEQ ID NO: 586 - DNA, 546 bp, Artificial Sequence
  Affymetrix ID 2681997
cccagagcgagacgactattccatggccctgagcagacaatttctcttttaaaaatggtggccctttaatgatgttattatgaggtttttaaatgacatatcaaaagttgtttatatcacaaaaacccaacagtcatttaattatactaatgaaggtctttatacgtgtcagattttttaaaaaagacttctaatggccatgagaaatggactgttgctgctgcttgcatcacagcagtggtggcagcattctttgtagaggaagaacatattttataatgtataagggaatttgcatttcgcttttcacggcaaacctttctgtgttttttgtaaatctaacaattgcaacaacatggaatatttagttgggagatgtttggagtaagtgttgaaagcaactatgtttgcttgcttttttttttttatggttagagaacaactgtggcgactttcacagattgaactagtacagttcaaaggaaaatcatcgactttagcacatctgatagctatataggcatggcagaggtgtcttgaaaaaac

SEQ ID NO: 587 - DNA, 138 bp, Artificial Sequence
  Affymetrix ID 2743344
ggtcctagaggaatttgagcagcgatgctacgacaatatgaatcatgccatagagactgaggaaggcctggggatcgaatatgatgaagatgttgtctgtgatgtctgccagtctcctgatggtgaggacggcaatga

SEQ ID NO: 588 - DNA, 198 bp, Artificial Sequence
  Affymetrix ID 2992873
ttcccaagcactgtacggggtattgggaaggtaagaacaaaaaagatgtagtccttgcccttacaggtctagttgaggaaagaaagggggattgttttccagttgcactgaatatgaatcagaatgaggaagaaagtacttggaagcctctagctgactctggtaccattccacggggccatgatacctttcttagtc

SEQ ID NO: 589 - DNA, 125 bp, Artificial Sequence
  Affymetrix ID 3568027
acatattttatgctatgccctgggggtaaagggtgactaagacgtgtaaggcacttgcattctacaggccattgcttttcatgggtataggttttctctccccagttagactgtaagccttgttt

SEQ ID NO: 590 - DNA, 434 bp, Artificial Sequence
  Affymetrix ID 3830188
ctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaata

SEQ ID NO: 591 - DNA, 2002 bp, Artificial Sequence
  Affymetrix ID 4011203
tcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttc

SEQ ID NO: 592 - DNA, 33 bp, Artificial Sequence
  Affymetrix ID 3349796
tgcagaaaaggtggataacccaactctggtggg

SEQ ID NO: 593 - DNA, 764 bp, Artificial Sequence
  Affymetrix ID 3040457
tgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtcca

SEQ ID NO: 594 - DNA, 27 bp, Artificial Sequence
  Affymetrix ID 3895503
gtggcggaccgtagaagagcaagccca

SEQ ID NO: 595 - DNA, 768 bp, Artificial Sequence
  Affymetrix ID 3907654
ccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagcc

SEQ ID NO: 596 - DNA, 141 bp, Artificial Sequence
  Affymetrix ID 3679982
aagagacacttttccctaagcaggaagttaataattaagttaaccaagaaatagaagtgcatgagtattgtttggaaatatggagaagggaagaagagtagaaacagctgaaaagattaaaagtgattgctttggcgaggt

SEQ ID NO: 597 - DNA, 64 bp, Artificial Sequence
  Affymetrix ID 2858366
agctacacaggaaataacaccaccaaaaataacacattcaaactcagagggcaatcttccctaa

SEQ ID NO: 598 - DNA, 152 bp, Artificial Sequence
  Affymetrix ID 3048215
accatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacac

SEQ ID NO: 599 - DNA, 239 bp, Artificial Sequence
  Affymetrix ID 3168775
atctgtagccgtagtaaattttggaagggcaaatcaatatggcgggtagaggctagttggtgaagcttattaacacagattcttttccaggctaaagttgtcttcagtggttaacctttgtttctcctagtagagaggtgggcaggataccttttgtctttgcaaatctatgtcttgatttaggcaagtggaaggcagagaggtttcttgcatctgctccttcaaaactaccttcagta

SEQ ID NO: 600 - DNA, 28 bp, Artificial Sequence
  Affymetrix ID 3643388
ggaggtattactgagcgccacctggctg

SEQ ID NO: 601 - DNA, 153 bp, Artificial Sequence
  Affymetrix ID 2927513
gtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctc

SEQ ID NO: 602 - DNA, 78 bp, Artificial Sequence
  Affymetrix ID 3911005
atgcctgagggcatcgaccagaacgaaccagacacgagtccctgccctctggaagctcacgttccagcagaggagagg

SEQ ID NO: 603 - DNA, 59 bp, Artificial Sequence
  Affymetrix ID 3942797
ttcatcctgggctactatagtcacaaccacagcatcctcatcggcatcactgaaccctt

SEQ ID NO: 604 - DNA, 148 bp, Artificial Sequence
  Affymetrix ID 2802457
ggcctatggtaggattgtaggcataagtgctggatcaggagtcatccctcttctacctctgctgccttctgatgtttcttttgccaaccagcacgccggaccagcccttcttgttttctcttttggttctaggtcacaactctttctc

SEQ ID NO: 605 - DNA, 88 bp, Artificial Sequence
  Affymetrix ID 2874851
caacacctgagcgtctcataatgcatttaatagaagaacattccatcgtggatccaacttatatagaagattttctattaacttacag

SEQ ID NO: 606 - DNA, 62 bp, Artificial Sequence
  Affymetrix ID 3147604
gaaattggctttacgatgaacatgttagacattggtggaggattcacgggaactgaatttca

SEQ ID NO: 607 - DNA, 48 bp, Artificial Sequence
  Affymetrix ID 3822303
tgccatataacatctggtgcgatggctgcaagaaccacatcggcatgg

SEQ ID NO: 608 - DNA, 170 bp, Artificial Sequence
  Affymetrix ID 2767313
ctgtctttggattgatggctcagagaagatggcagcatagatctttaaagcagtttgagtggggaattcttggatcttggggtacttggccatgtggacaggattggctggagaaggagggtcaggtggcggtcctgctgccaaggtctgagggtaatactgctcctaag

SEQ ID NO: 609 - DNA, 152 bp, Artificial Sequence
  Affymetrix ID 3159245
tgtgtgtctcaaacttcaagaagtctctaggataacccaaaggcaacaagggagaccaaaacaaggacgctggagacattttagcctctgatactgacagctgcagcaaacagaaaacgcagcctaaccgcgggccagataaaaacctcaca

SEQ ID NO: 610 - DNA, 26 bp, Artificial Sequence
  Affymetrix ID 3403122
gaagcagcggtcagcagacaaggaga

SEQ ID NO: 611 - DNA, 63 bp, Artificial Sequence
  Affymetrix ID 3849599
tgggcacccgttatcctagttactcgggcggctgaggcaggacaattgcttacccagaggccg

SEQ ID NO: 612 - DNA, 129 bp, Artificial Sequence
  Affymetrix ID 3534950
tgcctatgatcaccttgcatggacagcaatcctgtaaacatcacagagtggcatcatttgtataattatatgcattgttgtagtttgcacctgttggttttaatgtgcatgtgaatggcctagagaacc

SEQ ID NO: 613 - DNA, 125 bp, Artificial Sequence
  Affymetrix ID 3631427
ccctgttttgatatcctggttgtgaaatgtcttatgttttctgctaatctatttgtgttaaagtaagcagggttggtttacagtaccgtggctcaaaagctagtgtaggcagctttcctctcctg

SEQ ID NO: 614 - DNA, 510 bp, Artificial Sequence
  Affymetrix ID 3779594
acgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaa

SEQ ID NO: 615 - DNA, 328 bp, Artificial Sequence
  Affymetrix ID 3931281
cccgaggagcttgtgatgtcaccagtgtgccctgcgggatctggggaacaggagaagtaggccagagaagtcgggttgaaaggtgtgtcgtttgcgtcctggatctcccttaatttaaccccataacattccattttacagataaggagactgatgctcactaagacactaatatgcccactcacacagcaagtcccaagtctctccccaaaatgatttgagaattttgaggcacacaaaagggagaaaattgagtgcccgtgatccaacgttctgcaactgtttggaaaccaggaaagtggaggagtggtagtacttctgaacccta

SEQ ID NO: 616 - DNA, 119 bp, Artificial Sequence
  Affymetrix ID 3110077
tgggaagaggattcggactcgtcacactgcagagcagcagagcgagaaaggatgagaagaggcagagaaggcgacggcagaagaaaaaaggaaaaactgcggccgcgatcagagcctga

SEQ ID NO: 617 - DNA, 60 bp, Artificial Sequence
  Affymetrix ID 3419463
gcgccctcgccctgggaaactcactggagtggggacagatctcaggcgtttggcagtcac

SEQ ID NO: 618 - DNA, 43 bp, Artificial Sequence
  Affymetrix ID 3903370
attgtatttctattggacgctgctgctctaggttactgagttt

SEQ ID NO: 619 - DNA, 60 bp, Artificial Sequence
  Affymetrix ID 3609638
agaatcaggaaaattggtgcagggattggcacactgcagggagaatgcatgggctccatg

SEQ ID NO: 620 - DNA, 141 bp, Artificial Sequence
  Affymetrix ID 3227685
tcttgggtactcaccttcagccctagagcattctttagcactcacagtttctcttctcgtcgggttattctttatattaatcttttcctgtccaaattactctctatgtctcctgatcagtccttgactggaagcatcaag

SEQ ID NO: 621 - DNA, 196 bp, Artificial Sequence
  Affymetrix ID 3349840
cataacctctagagtagaaagtttcagaaggaagagattccccaaactgtgtaattcccttgtaaatctcattcattcaatgggatttgagaaccaaccacttgtgcaggtgcccgcatccgaagataacttgcccccaggagacagcagataagaagagggcagagacaaaggaggtctttttgcgacttgcatc

SEQ ID NO: 622 - DNA, 559 bp, Artificial Sequence
  Affymetrix ID 3035683
cccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaagcagtgatgtggtgtgtttattttcttttactcatctaggaacttgacgcagcttta

SEQ ID NO: 623 - DNA, 47 bp, Artificial Sequence
  Affymetrix ID 3439354
tcaagaaagagtcccgattgtgttccagtacctggttcttctggtct

SEQ ID NO: 624 - DNA, 105 bp, Artificial Sequence
  Affymetrix ID 2812078
ggcagtgctgtagggagcttcattaattatgatagtctcgctgtgtcaaatggattacaaatggaaccacctgtggggagcctgcaaggttacggacagaggcta

SEQ ID NO: 625 - DNA, 49 bp, Artificial Sequence
  Affymetrix ID 3038635
gatatgaaaaagcacgcatgcaactaactactgttgatctgctttgcta

SEQ ID NO: 626 - DNA, 45 bp, Artificial Sequence
  Affymetrix ID 3088092
acaagagggcgggtacaaacgcacagcttccagggctgaaataca

SEQ ID NO: 627 - DNA, 28 bp, Artificial Sequence
  Affymetrix ID 3337338
atgaaggacgagcgtgtgcccaagaacc

SEQ ID NO: 628 - DNA, 29 bp, Artificial Sequence
  Affymetrix ID 3420557
gtaagttgcctgtcgctcctctgaatttt

SEQ ID NO: 629 - DNA, 25 bp, Artificial Sequence
  Affymetrix ID 3841267
atggcggacaagcgcaaactccaag

SEQ ID NO: 630 - DNA, 173 bp, Artificial Sequence
  Affymetrix ID 2929962
tcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtc

SEQ ID NO: 631 - DNA, 66 bp, Artificial Sequence
  Affymetrix ID 2387074
gttgaggattatgcattgaggaagaacatatctgtggctgaggttgagaaatggcttggacccatt

SEQ ID NO: 632 - DNA, 122 bp, Artificial Sequence
  Affymetrix ID 3388958
gtaggtgccgaacaccgcgagtctccgcgcccgacccgacctcgtgttcgagtgtgtgcacgctggcgtttatggagagactagaagagccgcccacgttaagagtctacgtgccctgcagg

SEQ ID NO: 633 - DNA, 26 bp, Artificial Sequence
  Affymetrix ID 3620562
cccaaactgaaacatcatacctatta

SEQ ID NO: 634 - DNA, 25 bp, Artificial Sequence
  Affymetrix ID 3870278
gtttgacttctgactaaaggtcttg

SEQ ID NO: 635 - DNA, 29 bp, Artificial Sequence
  Affymetrix ID 2833045
tacctgcaagcggatgaggctaataaaag

SEQ ID NO: 636 - DNA, 37 bp, Artificial Sequence
  Affymetrix ID 3030300
gattgctgcactggacgactttagaacatccctcaca

SEQ ID NO: 637 - DNA, 33 bp, Artificial Sequence
  Affymetrix ID 3767510
agatcgaggacagtgttgagacaccaccacctc

SEQ ID NO: 638 - DNA, 29 bp, Artificial Sequence
  Affymetrix ID 3039444
gttcaaacagtagtttactcctgcctcag

SEQ ID NO: 639 - DNA, 27 bp, Artificial Sequence
  Affymetrix ID 3067653
agtatgggagaggggtaatgctgagca

SEQ ID NO: 640 - DNA, 85 bp, Artificial Sequence
  Affymetrix ID 3139926
aattaacaggcgaatgcacttctccaaaacaaaacacagcaagtttaatgaatctggtcagcttagtgcgttctacctttttgcc

SEQ ID NO: 641 - DNA, 62 bp, Artificial Sequence
  Affymetrix ID 3203423
atgtctatatctcgcccaaatgctgtggtcgggaggtgtcgcatgatccgccactcaagaga

SEQ ID NO: 642 - DNA, 39 bp, Artificial Sequence
  Affymetrix ID 3875984
tctttctctgggttcatttcctaactgtctaactttggg

SEQ ID NO: 643 - DNA, 51 bp, Artificial Sequence
  Affymetrix ID 2848542
atggtgtggcaagttgactgtatcgtgatgttagccgtcttgtggcagaga

SEQ ID NO: 644 - DNA, 56 bp, Artificial Sequence
  Affymetrix ID 3134299
agaccacagaaactgggcgggcagcagatgcagacacagccatcctatgcatttag

SEQ ID NO: 645 - DNA, 311 bp, Artificial Sequence
  Affymetrix ID 3538031
tgaccacgtgcgcaaattatttttcttttttagtagaatggtgcattttttgcctttgtatttgaaatttagctaaattacaatagctatcagaactacaattgaccttagtaatttcaaaaccatagttataagggttttaagttgatttttaaaaatcttaagatatgatagggatttcaaaactatgtgtgtgtatctctgatagggaggggttggggcacagactaataagtgtgccaaaaatctgtgaatccaaatgtgtaacaagtgttgtctgaataaatgtccacaaatccatgctattattg

SEQ ID NO: 646 - DNA, 119 bp, Artificial Sequence
  Affymetrix ID 4037525
tgtattagaatgtaatgaactttaatggaatgtactcgaatggattcgactggaatggaatgttctggaagtgaatggactccaatggaatggattcaaaaggaatggaatcgtacgga

SEQ ID NO: 647 - DNA, 148 bp, Artificial Sequence
  Affymetrix ID 2814589
agcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttc

SEQ ID NO: 648 - DNA, 25 bp, Artificial Sequence
  Affymetrix ID 2823139
tcccaacctggcagtgctgagtggg

SEQ ID NO: 649 - DNA, 34 bp, Artificial Sequence
  Affymetrix ID 3113389
ggacagaaccagctacaaccatagtgcctaccac

SEQ ID NO: 650 - DNA, 82 bp, Artificial Sequence
  Affymetrix ID 2853728
cagcagtgagagtcgtccagtccatggctcgtttcatggctgcctatttcaccaatcagcagctttgcattttgccccctca

SEQ ID NO: 651 - DNA, 131 bp, Artificial Sequence
  Affymetrix ID 3895815
gctcggatttcccacattacaacttcaggatgcctaatattggattccagaatctgcctctcaacatatatattgtggtttttggtactgctatatttgtcttcatccttagtttactcttctgttgctac

SEQ ID NO: 652 - DNA, 36 bp, Artificial Sequence
  Affymetrix ID 4013748
ttgttgatttagattcagacggtcctggtacttcat

SEQ ID NO: 653 - DNA, 232 bp, Artificial Sequence
  Affymetrix ID 3384440
ttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagc

SEQ ID NO: 654 - DNA, 177 bp, Artificial Sequence
  Affymetrix ID 4026568
aggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgca

SEQ ID NO: 655 - DNA, 27 bp, Artificial Sequence
  Affymetrix ID 2675946
gccagggatttgtaccatgggacttgg

SEQ ID NO: 656 - DNA, 33 bp, Artificial Sequence
  Affymetrix ID 2941689
tctccaactgcagcgacctgtggctcttcagat

SEQ ID NO: 657 - DNA, 100 bp, Artificial Sequence
  Affymetrix ID 2330052
gaaggcagtcatgtgtcaggacagagcaacggccgggatcctcaggccttggctaaggctgtgcaaatccaccatgatacccagcacacgatgtattttg

SEQ ID NO: 658 - DNA, 25 bp, Artificial Sequence
  Affymetrix ID 2726487
cgcagtgaggtctgacgtcatttcc

SEQ ID NO: 659 - DNA, 42 bp, Artificial Sequence
  Affymetrix ID 2902605
ccccagtgaccttgattcaccaacatccagcctgcgtcgcag

SEQ ID NO: 660 - DNA, 82 bp, Artificial Sequence
  Affymetrix ID 2732332
tcaaaagatttggagtctagagggcagaaattgaagaggttggtgctctgcacgtctgagtccgcccacagactgaataaat

SEQ ID NO: 661 - DNA, 71 bp, Artificial Sequence
  Affymetrix ID 2329455
ttcctggatcacaaagggctgtaggggttccagagatgctggagctctggtacaacaggagggccacaggc

SEQ ID NO: 662 - DNA, 27 bp, Artificial Sequence
  Affymetrix ID 2373856
gtatttgtggcttaaactcttggcatt

SEQ ID NO: 663 - DNA, 90 bp, Artificial Sequence
  Affymetrix ID 2465069
aaaaagcttggccagaccacaagcgggaatgcaaatgccttaaaagctgcaaacccagatatcctccagactccgttcgacttcttggca

SEQ ID NO: 664 - DNA, 25 bp, Artificial Sequence
  Affymetrix ID 3046899
tgatggcagctgaaattagccaaaa

SEQ ID NO: 665 - DNA, 134 bp, Artificial Sequence
  Affymetrix ID 3418387
ttgccgctttgcactgacctccagagggccagagggtgggatccagcgctatgtcctgcaggctgcagaccctgctatcagtcaggcctggatcaagcatgtggctcagatcttggagagccaacgggacttcc

SEQ ID NO: 666 - DNA, 144 bp, Artificial Sequence
  Affymetrix ID 3568670
ttcttgcagtagtgcgtgagctctcactcttgctctggggagtctggattagtccttgagggaatggattagttcctgcaagggtaggctgttataaagccaggatgctctcaggctctcctctgtttgcatgggttggcttcc

SEQ ID NO: 667 - DNA, 1060 bp, Artificial Sequence
  Affymetrix ID 2824307
aggcacaggctcaattagtttttcaaactctagccaaggcagtatttcatttgggaaatcatgcaacagaactgctcaattcttaacttctcctgctgttaacatttacacttagactgccagcaacagttaacttaaattttggtctcaagggaacaaaaaaaaattgcattcagaatttaatatagtattttaaaactaattttagcctgtaagtcattatgagcaatagtaacttttgtacctcctcatcttgtctgataatatattctatatgctgtcaatctgattatatagtctatatgctagaagttgctgattttcattctgccaccaagaaaactgtacttttatttatgggaaaaggatttaaatactcctagatacttaaaatttttttaatctaaaagttgattttctcccaagaacaattttgtttgctttctacaaagttttaagtttaataaaatgccggtaatcaccactgttttcctccccaaaataaatgctctgatccatattatattagagtgatactgtcacttagtattgatatctttaatattttttacatcatgagacattgttatgatcttacctgattgttatctcaaggtgagctaatcatctttatttgccttaaaaaatactgtactggctggatatttaatcttgttagtttagttatacacttgttttagtcgagtttaattcaaaaggactcttaacagtatggtgtaaaactcagattttctagtccagacaaattgctctctataacgatttggcagatcaatggagacatccgttttaactttactgttctgtacttactatgtagtcatgtgcagcttatcaacacaaagaatacggatgagggcatttaaatggactacaagtgactctgacttgtaaactagggaagcctcttgtgtttgaccttaaaggccagagaaaaactgaagatagattgacttaactattgccaagcagattatgggttactttatacttcctttcattctcccagaattgctcttagagctaggtgtcgtcatta

SEQ ID NO: 668 - DNA, 37 bp, Artificial Sequence
  Affymetrix ID 3204568
agccctcaggccctaccaaccttgactgtcctgtccc

SEQ ID NO: 669 - DNA, 275 bp, Artificial Sequence
  Affymetrix ID 3410647
cccaggagtactagttgagggccaggctgctgagaagcagttgaagtagccttgaagcaaggatgggagattgctgggtgagatcaaagatacgctgggatgggggtgagtgaaagtgtgagcaatgagtagaggcaagattgtagatgctgcatttggaggaatatttctgactgcataatcagaggtcagaatggctagagaaattaatacagaggtacaaggctagatttagaagagtaagctaagaacagactgcaatgggcttttgaatg

SEQ ID NO: 670 - DNA, 222 bp, Artificial Sequence
  Affymetrix ID 2555029
catccacgtacacatatgagctgtacacatagatgttaatcaggttgcttttttcattttatttaaatattcaaaatattgtgtgattgtgatccattgagatcattgaagtagtattaatttagctgggaattagcagcttatgttgtgtgggcccagttcatcaatatgtgtgtcaaatatccaccctcagatatcagcagcctttgacttgcagtcaga

SEQ ID NO: 671 - DNA, 25 bp, Artificial Sequence
  Affymetrix ID 3238290
tagtaccttaattggcctcccttca

SEQ ID NO: 672 - DNA, 31 bp, Artificial Sequence
  Affymetrix ID 3490689
tatagaggaaacctatcagggcagggacagt

SEQ ID NO: 673 - DNA, 191 bp, Artificial Sequence
  Affymetrix ID 3571835
catccatggattgggcccactactcatagcagctcctgaggcaggtaaatggggcaaggactcacgccaaataccacacgcgtatgtcaaacacccaaggtcggattctggggcccctgccctcaggaggctgtcagactgttccccctaaacacacttctgaaggttgtagggaccttgccctgctgtct

SEQ ID NO: 674 - DNA, 126 bp, Artificial Sequence
  Affymetrix ID 2318698
ggggcacccgttcattacttcgagaagcagctcacccttgcagttaaacttacttcaggaagagatgcccagaccctctgaatctccagatcagatgagaaggaacacgtgcccacaaactgagta

SEQ ID NO: 675 - DNA, 391 bp, Artificial Sequence
  Affymetrix ID 2330382
tggcccagctacatttgcaatgatgtgcacgtaaacactgttaagaggttaaagcttgtatacaatctgttactgtgaaataactaaattgggctttaaaaaaatcttagtatttattgatcttcattcacatatacagttgaaatttaaaataacagatggttattccaatgctgctgaaaccttttctaaaaaatacttgttttgttggttgaatgtgatgagaggcgcttctgggcagtctctcttctctcccacccgtctttcctcctccgagtaccccttctccagctttgtactagccatgtaaaacccaaggttttctttaaaacatcagaagagatctcgtcctccatgccccaaaaaagccaactcattggaggtgttaccc

SEQ ID NO: 676 - DNA, 34 bp, Artificial Sequence
  Affymetrix ID 3837059
ttgggtgttgaagtggaatcgtttcatcccagcc

SEQ ID NO: 677 - DNA, 135 bp, Artificial Sequence
  Affymetrix ID 2582942
tcaatcaggtcaaccacaggtcatatgaaaccatcttcccaactcccccacctccactggttctgaagagtgggtgtaaacaatgggttaaacaatccaggatgcagacagctgttaatcataactggctccaca

SEQ ID NO: 678 - DNA, 77 bp, Artificial Sequence
  Affymetrix ID 2876012
tgtctcatctaccaattcctgctattataagatcaacttctgcaaaaaccttatccacctcaagtatccttagcagc

SEQ ID NO: 679 - DNA, 81 bp, Artificial Sequence
  Affymetrix ID 3372066
ctttgccttaacttccacggatatctgggccctgtggcatgatgctgagaaccaaacagtagtgaaatacatcaactttga

SEQ ID NO: 680 - DNA, 78 bp, Artificial Sequence
  Affymetrix ID 3781765
gagatgcctcataaatttgtgatagccgtgctgatggaatacattcgttctcttaaccagtttcagattgcagtacag

SEQ ID NO: 681 - DNA, 28 bp, Artificial Sequence
  Affymetrix ID 3278980
ctggatcacaggtgcataccgccatgcc

SEQ ID NO: 682 - DNA, 357 bp, Artificial Sequence
  Affymetrix ID 3435777
gttcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatg

SEQ ID NO: 683 - DNA, 49 bp, Artificial Sequence
  Affymetrix ID 3524572
gctaggctgtctgcgaagaaggctaggagttcatagaagggagtggggc

SEQ ID NO: 684 - DNA, 81 bp, Artificial Sequence
  Affymetrix ID 3790001
cagaacaagtgcatctgctggcagccagcttaaggagttagcagccctcaattccaataacgaacgtgtaaatcagaattc

SEQ ID NO: 685 - DNA, 115 bp, Artificial Sequence
  Affymetrix ID 3301881
gaaggagatggataaagcagatgtttattggggcattccttatcccagctatggtgtgtggcactgccttcttcatcaatttcatagccatttattaccatgcttcaagagccat

SEQ ID NO: 686 - DNA, 36 bp, Artificial Sequence
  Affymetrix ID 2745373
tggcagattatgtggaccatcaacaaactaccaaaa

SEQ ID NO: 687 - DNA, 347 bp, Artificial Sequence
  Affymetrix ID 2774241
tgcacagacaattccctttactaggtgtcaccatagctaccatcttcatctccttcaaatgttgctttggcattgaggcttaccctcacttccttatttaaaattacaaccagctgggcgtggtggttcacatctgtaatcccagcaattttggaggccaaggtgggcagatcccttgagctcaggagttagagaccagcctgggcaacatggcaaaaccccatctctataaaaaatacagaaaaaacttagctgggtaatggtggcacacacctgtagtcccagctattcgggaggctgagacgggagaatcgcttgagcccaggagatccaagctgcggtgagtc

SEQ ID NO: 688 - DNA, 78 bp, Artificial Sequence
  Affymetrix ID 2852754
tacgacttacaggacagcagatggggaattcatggctgttggagcaatagaaccccagttctacgagctgctgatcaa

SEQ ID NO: 689 - DNA, 227 bp, Artificial Sequence
  Affymetrix ID 2390973
tttgccagtagcctcataatgagcgtgaggtagtatctcattgtagtgttaatttgcatttacctaacaattcgtgatgtggagcatcttttcatgggcttgttggctgctgtgtctcttctttggagaagtgtctgttgaagttgtttgacattttttaatcaagttgttggacaggttcccttgtttttaagtcagagtaggtgatgtttgtcttgaaggttata

SEQ ID NO: 690 - DNA, 52 bp, Artificial Sequence
  Affymetrix ID 3457600
accaagagaggcgaactccattgcatgctgctgcctacgtaggcgatgtccc

SEQ ID NO: 691 - DNA, 274 bp, Artificial Sequence
  Affymetrix ID 2853708
ccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatca

SEQ ID NO: 692 - DNA, 141 bp, Artificial Sequence
  Affymetrix ID 3055843
cccagatggagacacccatagcagggcgccggatccaatctcttcctctcctccctcggccttcctctccccacaaaccccagggtctagaaagtagaaggttctcccctcttctctccttcctcataatgaactcgatgg

SEQ ID NO: 693 - DNA, 210 bp, Artificial Sequence
  Affymetrix ID 3139045
catggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggca

SEQ ID NO: 694 - DNA, 36 bp, Artificial Sequence
  Affymetrix ID 3607791
ctgcctatttgcaatgccaccggaagtcaagggccc

SEQ ID NO: 695 - DNA, 27 bp, Artificial Sequence
  Affymetrix ID 2666907
accaagaaagaaatacgtggatgctga

SEQ ID NO: 696 - DNA, 25 bp, Artificial Sequence
  Affymetrix ID 3887309
ccagcagggggttcccatccttcct

SEQ ID NO: 697 - DNA, 38 bp, Artificial Sequence
  Affymetrix ID 2333654
tggaagacgagggattgccatcgcctatgaggatgagg

SEQ ID NO: 698 - DNA, 29 bp, Artificial Sequence
  Affymetrix ID 3333566
gtctgcggacgctgtataccctcctccac

SEQ ID NO: 699 - DNA, 44 bp, Artificial Sequence
  Affymetrix ID 3278417
aagccagagaagctcgacaccgtcaagtgaaattggagccaccc

SEQ ID NO: 700 - DNA, 100 bp, Artificial Sequence
  Affymetrix ID 3986088
tcgacacggagcacccttctagcttcttcgtctccaggactgacgctcaggctcctctctcgccttagcccaacttgctttcccgcctcgcaaactccgg

SEQ ID NO: 701 - DNA, 835 bp, Artificial Sequence
  Affymetrix ID 2558398
tgcccaccagccaactagacagatgtggcctgcattgtccccctggaggcaaaggatgtgtgggtatttatttatttaagatagtaagttatggccaggtgtggtggctcacgcctgtaatcccagcactttgggaggccgaggcgggtggatcacctgaagccaggagtttgagaccagcctggccaacatggtaaaccctgcctccactaaaaaatacaaaaattagctgggcatggtggtgcatgcctgtaatcccagctactcgggaggctgaggcaggagaatcgcttgaacccaggaggcggaggttgcagtgagccaagatcgtgccactgcactccagcctgggcaacagagcaagactccatctctaaaataaataaataaataaataaataaataaataagacaataaattatataagcagtgctgaatacagcttcatcatttaaaaatccaaacagtttggaaatatatagacaagtatataaatgctcttcttgcaccccttcccccatcctaaagcctaccatacaggtaggcactgttaattatttggtggaaatgtttacactttttgctttgcatttacacatgtgagtggcagggatagtatctgagaaattaatttttttctctcctgaattttctctttttctgccctcacatttatggagctcattacctccagagcagcttttcaggttagaaaactgaatttatcttcaggcatctctggcttttgtgtgctgaaagcttaagcatttagggcaactccaggatttgctgagtggctcatcaaaggatgaggattctcttgcacagactgaa

SEQ ID NO: 702 - DNA, 96 bp, Artificial Sequence
  Affymetrix ID 2830633
gcattgtgtatgctgaagccatcatcactctcgctcacaggaggttcattatccatttctgacaagtagccttctccttgatcctcttccttaggc

SEQ ID NO: 703 - DNA, 33 bp, Artificial Sequence
  Affymetrix ID 2546259
tatacccacatcactaagctgggaggcacattt

SEQ ID NO: 704 - DNA, 93 bp, Artificial Sequence
  Affymetrix ID 3615631
ttccgtgttgtggataccttgtacaatggaaaactgggctcttggcttgctattcgaattggtaaaaatcataaggaggtagaacgaggcatc

SEQ ID NO: 705 - DNA, 43 bp, Artificial Sequence
  Affymetrix ID 3729022
gagctcccaccttaccttggcaaactggatgtctcatttcaaa

SEQ ID NO: 706 - DNA, 173 bp, Artificial Sequence
  Affymetrix ID 3729073
tgatggcctcttgtcaggagagcagtggcacgggggcgtgaggaagagggaaaggggaaactctaagggtcctggcgcggggaaggggtggaagggtggaggtaggaacaaaattgcgccgctcctggagacctgataacttaggcttgaaataattgacttgtctaaaagga

SEQ ID NO: 707 - DNA, 67 bp, Artificial Sequence
  Affymetrix ID 3043777
tgcactacatcgctggcaagaattgttcagaaaggctggcctgctaacgacttctggggagattttc

SEQ ID NO: 708 - DNA, 30 bp, Artificial Sequence
  Affymetrix ID 3080463
aaggcacctacacaacatcaggccacttgg

SEQ ID NO: 709 - DNA, 110 bp, Artificial Sequence
  Affymetrix ID 2969705
ttgctaataaatgtaggccggaggggatggcttagtggtctaagcatcagatttgaaatacctagagtccctggaactgcaggtttgaatgtcagcagagtcaacccagc

SEQ ID NO: 710 - DNA, 77 bp, Artificial Sequence
  Affymetrix ID 2904894
attctggattttggactggctcggcacacagatgatgaaatgacaggctacgtggccactaggtggtacagggctcc

SEQ ID NO: 711 - DNA, 34 bp, Artificial Sequence
  Affymetrix ID 3421016
atgcctccagtatcggatatgtgggcaggcacaa

SEQ ID NO: 712 - DNA, 104 bp, Artificial Sequence
  Affymetrix ID 3724753
tgggttttatcggacccagtacagctctgccatgctggaaagtttattaccaggcattcgtgacctttctctgccccctgtggatcgacttggattacagaatg

SEQ ID NO: 713 - DNA, 107 bp, Artificial Sequence
  Affymetrix ID 2600045
tgttgtggagcgaaatatgagagacaaactatttttgacggggaaactggggtccaaactggatatcttggtggagaacatggggaggctcagctttgggtctaaca

SEQ ID NO: 714 - DNA, 318 bp, Artificial Sequence
  Affymetrix ID 2893581
tgcatttcagcttggagtgcgcagcatgaggcatttgtggttcagaaaagaggtcttcctttttcctcctcctgttttcttttccttccttctccccaactccccaaaggcttactgcctttcttctcaggccacgtgtgtagataacctttgaggaaaagatggtttccgtgctgggatatttggatattacctaaagggacaagatgagccctttctttgccttgttttctttctctggcctcatcagagtgaattatatctgactgtgtgacagttaattgtaccatccatcccgtgtcctaagctgataagccc

SEQ ID NO: 715 - DNA, 138 bp, Artificial Sequence
  Affymetrix ID 3712473
gtgtgtcccatccaagttgagcacgcgccttccccagcttgcagcagcacaccccaagcgctgcttttcacctgtacctttgttttattattattattattattgctgttgttgtcatcgttaactgtgggcatggaa

SEQ ID NO: 716 - DNA, 165 bp, Artificial Sequence
  Affymetrix ID 3026735
ccatgatgtgaaaggtcgggtgatatctgagagctgaaggaggttaagcggatccatgccaggctgacaaggggaacaggtgcctctgccctggactggagcctacgcaaccatcttctgctttatctagctgctgtctgtctcctgtctctgcgtgagtgtgtg

SEQ ID NO: 717 - DNA, 117 bp, Artificial Sequence
  Affymetrix ID 3603221
agtcgtgcagagtatcaagctcatcaccgagggggcgagcaagcgcattgctgagtttgcctttgagtatgcccggaacaaccaccggagcaacgtcacggcggtgcacaaagccaa

SEQ ID NO: 718 - DNA, 48 bp, Artificial Sequence
  Affymetrix ID 3820895
ccaggtggaccagaccggctccaagtccagtaacctcctggatctgaa

SEQ ID NO: 719 - DNA, 25 bp, Artificial Sequence
  Affymetrix ID 3183801
agaatgagaatttggctgccaattt

SEQ ID NO: 720 - DNA, 36 bp, Artificial Sequence
  Affymetrix ID 3420741
agaaaaaagtgtgaagacccgacagtgttgttttaa

SEQ ID NO: 721 - DNA, 144 bp, Artificial Sequence
  Affymetrix ID 2356132
cctgctatatggatgtcattcctgaagatcaccgattggagagcccaaccactcctctgctagatgacatggatggctctcaagacagccctatctttatgtatgcccctgagttcaagttcatgccaccaccgacttatactg

SEQ ID NO: 722 - DNA, 40 bp, Artificial Sequence
  Affymetrix ID 2625835
ctttcaaagagtggcggggactgcacttttattcatcaat

SEQ ID NO: 723 - DNA, 32 bp, Artificial Sequence
  Affymetrix ID 2996070
gtctgtcacctcgagatcttgtccttcatttt

SEQ ID NO: 724 - DNA, 25 bp, Artificial Sequence
  Affymetrix ID 3175548
cctcaatgggaaccctggtgcagaa

SEQ ID NO: 725 - DNA, 113 bp, Artificial Sequence
  Affymetrix ID 3810034
tagctgttcaggaaagctgtgtggctggagcagagaatatactggaaatcagagaggtcaaaaacaatgagcaggagatatcggaagaaatgttcctaaccacttcactcttc

SEQ ID NO: 726 - DNA, 111 bp, Artificial Sequence
  Affymetrix ID 2767097
agtatttcatgacaactctaagaaggttcagcactcaggggcagaatccgcaaatatcacctatttccaattatacttcacatgtgcatatgtgcacacacgacggctgtc

SEQ ID NO: 727 - DNA, 56 bp, Artificial Sequence
  Affymetrix ID 2853747
ttattctggggaatgcctgaagttaacatttctagcaattcggtggcatgagaatg

SEQ ID NO: 728 - DNA, 60 bp, Artificial Sequence
  Affymetrix ID 3016374
cgcagtttgtcagcatcgatgtgggactgggagaggaaggatattgccagttatggttga

SEQ ID NO: 729 - DNA, 96 bp, Artificial Sequence
  Affymetrix ID 3845911
tttatggcctgggaaacaatttgcatttgtccccaaatacgcttagctgtgtgccgcttagaacgatgcgaaaccatccctctgtgtaagcccgtg

SEQ ID NO: 730 - DNA, 368 bp, Artificial Sequence
  Affymetrix ID 2642763
gtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatc

SEQ ID NO: 731 - DNA, 76 bp, Artificial Sequence
  Affymetrix ID 3642784
tgtcacccccgccatcactgctggacaggagccacccccttgggtaccagagggagctgtgcattgtgaataaaga

SEQ ID NO: 732 - DNA, 25 bp, Artificial Sequence
  Affymetrix ID 3178621
tgttaccgaggttttcaaacagtga

SEQ ID NO: 733 - DNA, 95 bp, Artificial Sequence
  Affymetrix ID 3681988
cgatcggtgcagtgaatagcctccacagatacaaaattggcagcaaaaagatcctggtctcacttgccaccggggctgccagcaaatcactctct

SEQ ID NO: 734 - DNA, 157 bp, Artificial Sequence
  Affymetrix ID 2973750
ggagcgtgggagttcatattttacactatgttggtacttaccatgcaaatgaacggccctgctgggaaaagaacctttatccagagaggggatccgaggaaatagtaagagttgggttccgagaagctgtgctgcatcacgggagagctcggtgtta

SEQ ID NO: 735 - DNA, 443 bp, Artificial Sequence
  Affymetrix ID 3284084
atggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccattt

SEQ ID NO: 736 - DNA, 83 bp, Artificial Sequence
  Affymetrix ID 3642301
ccacaggagacacgaggccgaggtggcgcagcacccaccctacacagcagtggccatgtgccaattacacgtgctgggaggag

SEQ ID NO: 737 - DNA, 128 bp, Artificial Sequence
  Affymetrix ID 3133236
tgtgtctgaacgatggccgcatgactttggtgggcatcatcagctggggcctgggctgtggacagaaggatgtcccgggtgtgtacaccaaggttaccaactacctagactggattcgtgacaacatg

SEQ ID NO: 738 - DNA, 405 bp, Artificial Sequence
  Affymetrix ID 2858415
gctggtaataatcgcgtttttggtaaaaacacctcatggaatttttttcctttctcataaaatagctgtttactgtaaaattgagatagcctctcaagtctggaacacctttcaattcatcaaaaagggacaacctaatattccaaagaagactcaatccttttaacacacatacattttagggccagtcaagagaagtggcctgttctgtaggaaaacatttcttggcacattattattttaagtgattgcaggagaccacagagggagagaaaagagacaacaacaacttctagcatgcctgggggatgacttgctctttcatatttgtggaaccctatgtcaagagagaaaacatctaaaaataaaaacgcatttactcagattctctagggcaaggtgcaa

SEQ ID NO: 739 - DNA, 332 bp, Artificial Sequence
  Affymetrix ID 3301253
cttgtggcattgtgctaaagcaaaaaggaatggaatttgcaatgagagagcctttcaagttcaggctcagcctttagctgtgtgaacttgaaccactcacaatttttctgaatctcaatttcctcatctgtaaagtttatctaatatgttggtggtgaggtaatcatattattatctcaaataggagattgtatatgaaagggctttggaaaggcaaatcccattatttgtttaaatcaattttttcccctaaaaaagatagctcataaaagaatgtgaacttaatctgtatgtgtaatttctttcaagtcctatctgatgttgcttgtgac

SEQ ID NO: 740 - DNA, 79 bp, Artificial Sequence
  Affymetrix ID 3068212
aatgcctgtagtgtccagtaccgacgaccctttggctgtgcagttcttagcatcgctgacctgctaacaggagagacaa

SEQ ID NO: 741 - DNA, 30 bp, Artificial Sequence
  Affymetrix ID 3664307
ccagcaattctgaggcagggaccaatcaga

SEQ ID NO: 742 - DNA, 110 bp, Artificial Sequence
  Affymetrix ID 2357616
atgtggattgtctaactggaggttgggagtccagggtgcagaaggagaagcttggagtgcaggatttggtggtatgtgtgtggcagtaggcactatgttctaattgccag

SEQ ID NO: 743 - DNA, 26 bp, Artificial Sequence
  Affymetrix ID 2824047
atgaccagagtcataggtggtgatgt

SEQ ID NO: 744 - DNA, 60 bp, Artificial Sequence
  Affymetrix ID 3348756
atttaagcgagagcctcactggttcccaggacatcaacctgaactggatcctccccgata

SEQ ID NO: 745 - DNA, 354 bp, Artificial Sequence
  Affymetrix ID 3561991
cttatttgatgggtggccaagatactgggtagggtggtgtgatttgctatactgagtagatcagtaaacaataaagtataaatcttgctttgtagttggaaggtcagttaacaaatatttagtcaatatgatgctggagttggctaatgtatcccccaggtctaattaatgaaaataatcttgcattggtctttaggaaaatcatttttattctctttctgaatacttaaccatagttgtttacatgttttactgtggaagtaatatcttttatgaatgttttagagaaaacaattatggttcacttggaccattcagtaatttgtccagcctggctagtttctagttatctga

SEQ ID NO: 746 - DNA, 59 bp, Artificial Sequence
  Affymetrix ID 3051857
agagaagaatcctccgacggcttcgttaccatcctgtctgaagcggattgcacgagccc

SEQ ID NO: 747 - DNA, 618 bp, Artificial Sequence
  Affymetrix ID 3459696
tgagcttcacatggggtcaaactggaaagtatctctttgctatgctcccatttaattaaattaggaaatctgcctaaaacttgaatcactcctcttttcagctggtggccaggcaggaatgctccctgaagagtactctttcaatagacttcagaatgtgttacctgaaaagtgctcatgatgaatcaagacatcactgtgttttccatacttctgaagtagagattgtccactaacagcttagggaaagcagagtacccgctcagctgctctttttctggtgtggtcagaccagctgggtcctctgaaacatgaatccatagtgcttcctttgttatactatttctgactcagttttctctaaacggctgtaaaatttaactgcctagctgtattttctttctgtggactttatgctctcatatttaggagaaagaataagagaacaccaacttacatctctgtagctctggatgattattaaggccctggtctaatgcttaaaggtaagcatctgttatctatattcaataaaagaggaaaatgaaccccagagagaaatcaagttactttagaatcgcaggctgtcccatgaccctggtgaccatcactgaatta

SEQ ID NO: 748 - DNA, 84 bp, Artificial Sequence
  Affymetrix ID 2614179
gtgaagccatcagtgtctacagcttcagctattgcccgtgtgcagatggtgcttaatctctcttgtgccttccagacctgcatt

SEQ ID NO: 749 - DNA, 131 bp, Artificial Sequence
  Affymetrix ID 3047613
attaggtgatggtagcggactagccgacggagggcaggcaggggagggggagaggactttacagaaaaggaattctcggtcgagctctgcctggagatgactggcttacacttactaaacccagcgggtca

SEQ ID NO: 750 - DNA, 60 bp, Artificial Sequence
  Affymetrix ID 3677890
atcaacagccgccatcttgtcgcggacccgaccggggcttcgagcgcgatctactcggcc

SEQ ID NO: 751 - DNA, 32 bp, Artificial Sequence
  Affymetrix ID 3177929
tgacaattcaagatagtttgcagcatccctgg

SEQ ID NO: 752 - DNA, 106 bp, Artificial Sequence
  Affymetrix ID 3211613
tcctggtcccagacagtctaagaggcacagataaacgcagaaatggacctgaattttccaatgacatcaagaaaaggaaggtggatgataaggactccagccacta

SEQ ID NO: 753 - DNA, 287 bp, Artificial Sequence
  Affymetrix ID 3452723
tgtgagaaggtgaagcccataaggcacagaaggagttcagtgagaccagtgacttcaggctcagtgtgggagaccaggggaaggatgggcatgcagggggcgggggactaggctgtgggggaggcaggatgcatggaaggtagggaaggctgaggaggtggagccaaagtcggaggtgggagaagggctgtgggtccctgtgggaccctcatggggctcaggggctggaatgaaggaggtagatgagagggtctaaagctggaacatcatgagttgagcatgggatg

SEQ ID NO: 754 - DNA, 30 bp, Artificial Sequence
  Affymetrix ID 2845333
ggggctaacatggacggtcaggagctacgt

SEQ ID NO: 755 - DNA, 202 bp, Artificial Sequence
  Affymetrix ID 2852760
tgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtgacagccttttaaaaactggtgtttggggctggtatcactccagtggattc

SEQ ID NO: 756 - DNA, 150 bp, Artificial Sequence
  Affymetrix ID 2750640
caataagatagacggaaatataatatttaaggttagagaagaaggctgagtgtggtggctcactcctgtaatcccagcactttgggaggctgaggcaggacaatcacttgagctggggagtttgagaccactcagactcacttgagacca

SEQ ID NO: 757 - DNA, 63 bp, Artificial Sequence
  Affymetrix ID 2807722
ttcttatgcaaacaacaccatctgggctctggaacttcacaaaaggacactgttaagtcacac

SEQ ID NO: 758 - DNA, 37 bp, Artificial Sequence
  Affymetrix ID 3338718
tcatccatcaggctgtgtcagacgcacctgagccctc

SEQ ID NO: 759 - DNA, 28 bp, Artificial Sequence
  Affymetrix ID 3482760
tgaccccagacctagggttgctggtgga

SEQ ID NO: 760 - DNA, 32 bp, Artificial Sequence
  Affymetrix ID 3884900
tgcttcgattgctttcgagtcatgagttggtg

SEQ ID NO: 761 - DNA, 77 bp, Artificial Sequence
  Affymetrix ID 3038653
aaatgtgggcccgttaaagagcaagactctagaaaggaatctagccaaagaggacagcgttggtgggatggggataa

SEQ ID NO: 762 - DNA, 75 bp, Artificial Sequence
  Affymetrix ID 3340340
agtcagagctgtagtgacacagcccaggaaagagcgaagagcagagtcagagcagttccaggcaacaaagccaag

SEQ ID NO: 763 - DNA, 165 bp, Artificial Sequence
  Affymetrix ID 3441973
agtgctgtctacacgctgagtattaaatcctaaatgtgtatctttagctgacaacctctcccttgaactctgcactcacataaccaacaatctaaacctctccctcccatatgctaccccatctcagtaaatggcaacttcattcttctagttgctcaagtcaaa

SEQ ID NO: 764 - DNA, 78 bp, Artificial Sequence
  Affymetrix ID 3629351
acccggtgtgttcttgtatagtcagtggcatcagcacccgtcagccggccttttccttcaggttcgtcaggctcaccg

SEQ ID NO: 765 - DNA, 38 bp, Artificial Sequence
  Affymetrix ID 2611420
gtgctggcaccatcgagccacaactcaggggcctcatc

SEQ ID NO: 766 - DNA, 27 bp, Artificial Sequence
  Affymetrix ID 3371610
acagttttgagacaggtggttcaggtg

SEQ ID NO: 767 - DNA, 147 bp, Artificial Sequence
  Affymetrix ID 3795789
gcctggctcttccttaccacccggattttgtttttgctttctgggtagagctctgatgttgccaaacagcctgtgctcctcgtgaacaatctctccagactcaaaatagcgagcagccaaggggctgccactgcttgcggtccacag

SEQ ID NO: 768 - DNA, 27 bp, Artificial Sequence
  Affymetrix ID 3118031
aggaaataactttacatgtgctcctct

SEQ ID NO: 769 - DNA, 213 bp, Artificial Sequence
  Affymetrix ID 2976043
tcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagaga

SEQ ID NO: 770 - DNA, 26 bp, Artificial Sequence
  Affymetrix ID 3330211
attactgaaagtggcgtgcactgaca

SEQ ID NO: 771 - DNA, 25 bp, Artificial Sequence
  Affymetrix ID 2397801
atgccagagactgtgatgttggaaa

SEQ ID NO: 772 - DNA, 25 bp, Artificial Sequence
  Affymetrix ID 2537317
aatacatcaatgaggcggctgcgat

SEQ ID NO: 773 - DNA, 346 bp, Artificial Sequence
  Affymetrix ID 2875953
caatagtgcaatatcacgaccaggatattaacattggtacagtcaaaatacggggcattaccatcaccacaaggatatctcatattgcccttataaagccaccccacttccctcctacctcacccctcctgaactcctggtaaccacaaattatccatttgtataagttggtaattttgagaatcttacataaatggaataatacagtatgtaacttttgggattgactttttttcacttagcataattctctgaagattcacctaggttgttacatgtgtcaatagtttgttcctttttaaattttaacttttattttttcgagagtaagtcttgcactccaggc

SEQ ID NO: 774 - DNA, 25 bp, Artificial Sequence
  Affymetrix ID 2882417
aggaaagcatgagaggtcagcagca

SEQ ID NO: 775 - DNA, 263 bp, Artificial Sequence
  Affymetrix ID 3095010
catgcagtacattggatatgatataatttatggtttcttgtttgcagctgtttgtatctttttaatcccaaaccagacaaaattataaacattttatatacaatgttatcttggaaaaagttagatgtaaataattcatcttaatctatatttgagaaatctgaggggtattaggaaactcatgagtgaatgaacatatagattggatcaaaggaggagagtatgagagtagggagaccaggtaaaaaggtatcatagtcatc

SEQ ID NO: 776 - DNA, 30 bp, Artificial Sequence
  Affymetrix ID 3450794
ggatgctcctttaaacagcccaggatcaga

SEQ ID NO: 777 - DNA, 35 bp, Artificial Sequence
  Affymetrix ID 3627349
tcttctggctcttccgtgacgcattacaacagcca

SEQ ID NO: 778 - DNA, 25 bp, Artificial Sequence
  Affymetrix ID 2360857
gggagcagctgatcaggtttctgac

SEQ ID NO: 779 - DNA, 31 bp, Artificial Sequence
  Affymetrix ID 3821204
gtgcggtggatactgacctttgctccggcct

SEQ ID NO: 780 - DNA, 34 bp, Artificial Sequence
  Affymetrix ID 3665595
tggaggatgaggacgtgcagactcgagtggctgg

SEQ ID NO: 781 - DNA, 670 bp, Artificial Sequence
  Affymetrix ID 2852747
caggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttc

SEQ ID NO: 782 - DNA, 29 bp, Artificial Sequence
  Affymetrix ID 3004680
tggatgagtgtaagggacaccaaggaggt

SEQ ID NO: 783 - DNA, 26 bp, Artificial Sequence
  Affymetrix ID 2722233
tgaaattcataaaggcatgtgtgcca

SEQ ID NO: 784 - DNA, 274 bp, Artificial Sequence
  Affymetrix ID 2805960
cccagggcattagagtgacctcacaagagtatctcagaatatttaaaaatttgaacacacaaacacaatgaaactcaacatctgtcagacatcacgtgaactactagtgaggtagttcattctttcaacataagattgcactataatccttctgataatttcatatttttgtgagactgggttttccaggccatctgataaaaaatcaagtactatatggacaccaacatggagcagaaaatgagggcagcagtgtccaatctcattccaggtg

SEQ ID NO: 785 - DNA, 33 bp, Artificial Sequence
  Affymetrix ID 2952396
aggaatggaattaataggttgtggcaatatcaa

SEQ ID NO: 786 - DNA, 30 bp, Artificial Sequence
  Affymetrix ID 2612927
caacccaatctacagttgtgggcagtggct

SEQ ID NO: 787 - DNA, 216 bp, Artificial Sequence
  Affymetrix ID 2640231
tgcccggcctgcaataagtatttctaaataagatcacattctcagctacaagaatttaggatttcaacatcttttgaggaggactcaatttaacccataagaatactatgtgggccacacatggtgcttcacatctgttatcccagtatttcgggaagttgaagcaggaggatcattgctcagggcctatggggacaccgggtgcataagaccaca

SEQ ID NO: 788 - DNA, 30 bp, Artificial Sequence
  Affymetrix ID 3371122
agcaggaaatggaatatgcgggtcacactg

SEQ ID NO: 789 - DNA, 41 bp, Artificial Sequence
  Affymetrix ID 2972930
gctgtgacacaacagtgtggcgatgtcccacagacctgaaa

SEQ ID NO: 790 - DNA, 79 bp, Artificial Sequence
  Affymetrix ID 3529011
agcggctgcagcacgtagttggagaaggtgagggcgatgacagcctggttggtggggtagatcaccagcacagcaatcc

SEQ ID NO: 791 - DNA, 930 bp, Artificial Sequence
  Affymetrix ID 3670860
gagccagccaccacgttagattttagagtctcctggagcacgtgaaaacaactgaaaaagggtaaccacacatcatttcacttgtgatgtagcttgcctgtctccacaccatgcccctgaagaatagtatatcacctacagccccttccccagtcaggaatggaagtgcatgacacatgtgctcctctaccccttccatgctcatggcagacatcattaatcaattatagcactctttctgtagagccagagacagcatcacactctttcccctcctgcattccaggccaccactaccaactgaaatcgtgttagtaccataatgaatgctatgtaccattctctaccctaagcgattgcaaactgtaaatgaattgttgctgatttctgagcccctcctagatttggggtaaattcatttcttgttttcagaacacaggggatagggacaccctgtgcagttctttctccaggacaaggagactccccactgggggatggggcggggtttctgccttaatttgggcgctcatagtttcaaggaggagctctttctggctttggccagctagaaggaaaggtgccctgtttgttaactttaaaatcactacgggtgtagtgtatggagtgggctgtgccatgctggagttcagagcaaaggttcttcaggttttcttgcgaaggaccttaacttgtcaatggcagagccacacccccgggacatacttggcagaggaatgcctcttcaggcacataaacatttttgcatactccatgttagtcaataaaccgtttcataagggttctttgaggacatctgacttcaaagggaaaaaattcataattcagacaggctctcggggcttcaccatacaacgcctttcttgtatttggttagttttatgggcctggagtgttgaccatgtatta

SEQ ID NO: 792 - DNA, 577 bp, Artificial Sequence
  Affymetrix ID 3844568
ttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccttgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccagtcctgccctcccagctgtcgacccagatgggatgttc

SEQ ID NO: 793 - DNA, 444 bp, Artificial Sequence
  Affymetrix ID 2810517
cagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaa

SEQ ID NO: 794 - DNA, 26 bp, Artificial Sequence
  Affymetrix ID 2377968
gtaagacacgttcccagaggcaggac

SEQ ID NO: 795 - DNA, 65 bp, Artificial Sequence
  Affymetrix ID 3020324
tatgtaatgagcatgtgcatagtgtgtgtatgtgtttgtatgtgtttgtggggggtaatggtctc

SEQ ID NO: 796 - DNA, 110 bp, Artificial Sequence
  Affymetrix ID 3133424
cctgagctggcttggtggcatcccaggctcgtgccaggacccagcagggctggtttccatgggcctgaaaaggcccacatcagaattccagggcataggcgaggattact

SEQ ID NO: 797 - DNA, 25 bp, Artificial Sequence
  Affymetrix ID 3225212
cttcctctttccctcggagcgggcg

SEQ ID NO: 798 - DNA, 26 bp, Artificial Sequence
  Affymetrix ID 3731955
tggaaccctcaggtgttcgcaggtgt

SEQ ID NO: 799 - DNA, 29 bp, Artificial Sequence
  Affymetrix ID 4012443
ggagtaggggtcaactggattttgccagc

SEQ ID NO: 800 - DNA, 73 bp, Artificial Sequence
  Affymetrix ID 3145052
ttgatgaccccagaaggagttggccttaccactgccttacgtgttctctgtaatgttgcatgcccaccacctc

SEQ ID NO: 801 - DNA, 99 bp, Artificial Sequence
  Affymetrix ID 3542308
gggacggtgcacatgtgcattcacatgtgttttatggatgctacagaggaatatcagaagagaggaagagggccccaaacagcccctttagctctgaaa

SEQ ID NO: 802 - DNA, 30 bp, Artificial Sequence
  Affymetrix ID 2385170
atggcaggccccaatgtggcgtgcattgag

SEQ ID NO: 803 - DNA, 1168 bp, Artificial Sequence
  Affymetrix ID 2617336
ggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtc

SEQ ID NO: 804 - DNA, 156 bp, Artificial Sequence
  Affymetrix ID 2982034
catggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaaca

SEQ ID NO: 805 - DNA, 27 bp, Artificial Sequence
  Affymetrix ID 2335196
gtacaggaatccagctgtgtggagcag

SEQ ID NO: 806 - DNA, 76 bp, Artificial Sequence
  Affymetrix ID 3561721
tccagctatacacccgtaacccaacagcggctcaaccctgggcgccaactaccgctgcgtcctccgccgcttttcg

SEQ ID NO: 807 - DNA, 29 bp, Artificial Sequence
  Affymetrix ID 2819696
gataatagtagtatggatggcagtggcat

SEQ ID NO: 808 - DNA, 845 bp, Artificial Sequence
  Affymetrix ID 3408052
catgatggttgtcttcactctcctactcccaatgattcctagaaaagaaactttaaaacatgtttctacttcccattctgcagtttagtaaaatgatttggttaactcttaaaactttttgtggaataatgttctgtgaattcaagtatacaaggcaggaggatcacttcaggccaggagttccataccagcttgggcaacatagcaagaccccgtctctacaaaaaacaaaaagagaaaaaaaatatataatacttgaggtagttgaattgccgtgatttattgtcaccaatatttttaaatcttatatttattataataatacacattacatttttataactgggttataacattgattattctcacttattctagatgtgacttatttaaataagtttagaattatatattaaatacaattatattaaaaacatttttgcttttatgtaaaacactatttgccatgacattttttgtcacgtaattttgtttttctttgtgtttgaatatgatcaaatacttcccaaaattaaacttacaaatgtatatcaacatattataattcaaaagctgtttttatttgggaaataaataacaatgtgtaaagaccgggaatttgttctcctacctaagcctgatgattaaaagacagtgtaactatgcaggtgttaaacattttctatattcttacagccatctctgttcatatatccatttttaactccacgcccctgtaagcctttgagtttgtgatccctggtgaagacagtgacccacattgattttttttttttttaaggtttctctctctcttttttgctttttctctcgaatataggacc

SEQ ID NO: 809 - DNA, 170 bp, Artificial Sequence
  Affymetrix ID 3628699
attcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgcta

SEQ ID NO: 810 - DNA, 184 bp, Artificial Sequence
  Affymetrix ID 3350729
tgcagacgtgcacattcccagtccgtgccccagccgtcctgggtccccttacaagcccgggtctgccacttcacccttgtttttccccatcctccgggtccacatttcatatgcccctgccctcattcccttatgattccctagctgctggttccagagtcttctgggcttacagtctcccggc

SEQ ID NO: 811 - DNA, 92 bp, Artificial Sequence
  Affymetrix ID 3380411
aaagcaaggaaggtattgaagacacaaagtcacatgtgatgggctcaggagccagtgtgaggaagggctgctcatacagcacagtggaggat

SEQ ID NO: 812 - DNA, 90 bp, Artificial Sequence
  Affymetrix ID 2377588
cccatagagctcctaaccagatgcaacagtgactgcgtcaccattccccacttttcccaactacgcagtgacaaacctaccagctttacc

SEQ ID NO: 813 - DNA, 26 bp, Artificial Sequence
  Affymetrix ID 3219836
tgggagccgtggatgaaattgtgctc

SEQ ID NO: 814 - DNA, 40 bp, Artificial Sequence
  Affymetrix ID 2737650
catcatgaaagcaggaagacatacgggcagagtgcagatg

SEQ ID NO: 815 - DNA, 343 bp, Artificial Sequence
  Affymetrix ID 2843633
aggctcgccttctcaatagcgtgtatttggatgagatgagtttcttctgtaaagagaaaaagatgttaaaacctcattgtctaaggcccctcatctgagaagtcttgtctgaccctctagcccagcaggaccaaggtgtggtgcctggtcccagcctgtcctctgctcccctgggctgcagttggcccagttgcctgcctccattagatacggagttgctctggggctgagatgcccatctcaagtgcattctgtcggaagggttctctgctggaaggcctttggttttagttgggattccatgagctttagcccaaaggtggcctcccatactagcatattt

SEQ ID NO: 816 - DNA, 110 bp, Artificial Sequence
  Affymetrix ID 3478420
ccactgtccacagaccatctggggccctggagggagcgggctgggccagggaggaacaactgggaaggggcagggaagaatcactgaacatcagtgtgaaggtggcctga

SEQ ID NO: 817 - DNA, 72 bp, Artificial Sequence
  Affymetrix ID 2749415
agcttttcaagacacttcctgcatctctgacctgttgcacctctgttatcttggcacctctgttatcttagc

SEQ ID NO: 818 - DNA, 367 bp, Artificial Sequence
  Affymetrix ID 2921363
tgacgcgggtcttacctgggctaaattcaaggtgctggcaggaatgcattcctttatggaggttttggggtagggggcaaatccatttccttgtttatttagttgttggcagaattcagttctttgcagttaaaggatcaaagtctcctttccttgttgtctgttagctgagggtcatttctagcttctgaaggctgccttcattccttggctcatgatccccttttcttcagagcctgcaatagtgggtgaagtccctctcccattttgaatcattcctgttacttctatcatccctctctctgacctacccttctgtcttccatttccactgttaaatgtctatttgattactctgggcccactt

SEQ ID NO: 819 - DNA, 29 bp, Artificial Sequence
  Affymetrix ID 2703246
tagttttgaactgtgatgctctttcacac

SEQ ID NO: 820 - DNA, 26 bp, Artificial Sequence
  Affymetrix ID 3226615
gctcgcagcctttcttcggagagtgg

SEQ ID NO: 821 - DNA, 58 bp, Artificial Sequence
  Affymetrix ID 3373866
attactttaaggatctgtgtggaccagatgctgggccgattggcaatgccacagggca

SEQ ID NO: 822 - DNA, 40 bp, Artificial Sequence
  Affymetrix ID 2852746
ctggtagcaagttctggatcttatacccaacacacagcaa

SEQ ID NO: 823 - DNA, 500 bp, Artificial Sequence
  Affymetrix ID 3023100
ggctcctatccctacatttcaaatagcatttctctcacaattgattatgtattaaggcttgtcaacgaaaaggaaacttttttctctcagaatttctagaacttttttctttaaaaagttttttattctgtagccagaaaaatttaaagtttgtgctgggttgctttggttatagaactaatgaagcttgagtaatagtttcagacattctcagggtttttcttctgcagccagattttacacttctattatctcagctgtcttataaatgtattccctccatcacacaatataattagaatgtattgatgaacagatgtaacttcatcactagagagacgttaaataaattatgtgttggtatcatgacttttatcaaatcatgaaggatgccatcacttttatgtgatagtccattggtatagtactaaagtttgtaagtaaagaatgtcagatagataacaagataacttcattttcgagatctcataacctgggcc

SEQ ID NO: 824 - DNA, 238 bp, Artificial Sequence
  Affymetrix ID 3431525
tggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtcca

SEQ ID NO: 825 - DNA, 59 bp, Artificial Sequence
  Affymetrix ID 3695469
tttatcctgatggaaagagtccagtagagaggaagagattgatgatgtaggagagagga

SEQ ID NO: 826 - DNA, 147 bp, Artificial Sequence
  Affymetrix ID 3761535
ctgccaccgccactaacggagatggccctggtagagacctttgggggtctggaacctctggactccccatgctctaactcccacactctgctatcagaaacttaaacttgaggattttctctgtttttcactcgcaataaattcaga

SEQ ID NO: 827 - DNA, 208 bp, Artificial Sequence
  Affymetrix ID 3823884
actgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagc

SEQ ID NO: 828 - DNA, 1709 bp, Artificial Sequence
  Affymetrix ID 2475018
ctcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggttt

SEQ ID NO: 829 - DNA, 25 bp, Artificial Sequence
  Affymetrix ID 2987324
gttggtgcccaacatatgcctgcca

SEQ ID NO: 830 - DNA, 30 bp, Artificial Sequence
  Affymetrix ID 3379421
cgcctttccttcgaggagctcaaggcattt

SEQ ID NO: 831 - DNA, 43 bp, Artificial Sequence
  Affymetrix ID 3109159
cattcagcactctcacgggatggacagagcagtgttcatgcag

SEQ ID NO: 832 - DNA, 26 bp, Artificial Sequence
  Affymetrix ID 2480318
ctctgacgcacttgaggggttggctc

SEQ ID NO: 833 - DNA, 263 bp, Artificial Sequence
  Affymetrix ID 2841516
gcagggatctagacgtcaggccaactgagagctgacagggaagagagagctagctagtatagacatagacatgagaatcagctcagctgctgtaggagaaagtcactgacagacagtagcatccaaggcatccagcgttatatgacccacgaaaacccccaaaattaaatatacacaataaaaggtcaaatgtttttcttgaacaaaagtatatttatattgaaaacaatcaggtgaagagtagaccctaatcgccagtattt

SEQ ID NO: 834 - DNA, 25 bp, Artificial Sequence
  Affymetrix ID 3738805
ggagcttcttacctgctcacactgg

SEQ ID NO: 835 - DNA, 49 bp, Artificial Sequence
  Affymetrix ID 2771466
aaaagagagcaatcctgcaagccaatcccgactctgaaaatcatcacta

SEQ ID NO: 836 - DNA, 45 bp, Artificial Sequence
  Affymetrix ID 3322962
tggtggtgatgcttatagtggagagcctctaccttgctgcagctc

SEQ ID NO: 837 - DNA, 26 bp, Artificial Sequence
  Affymetrix ID 3906050
tagatctccaaaatgacctctcacca

SEQ ID NO: 838 - DNA, 61 bp, Artificial Sequence
  Affymetrix ID 3119642
ccagagaaagccgctgacagggaggagaggccccagcccctattacaaacccagccatcaa

SEQ ID NO: 839 - DNA, 25 bp, Artificial Sequence
  Affymetrix ID 3125570
ccccaaaaccatctgcaacagccag

SEQ ID NO: 840 - DNA, 42 bp, Artificial Sequence
  Affymetrix ID 3933835
ctgatggaccttctggccgcttctatgtttcttctctgattg

SEQ ID NO: 841 - DNA, 25 bp, Artificial Sequence
  Affymetrix ID 2802644
gggatcacttgccacctgggatgtt

SEQ ID NO: 842 - DNA, 127 bp, Artificial Sequence
  Affymetrix ID 2854122
aagttctgtgttagatagtcaagtagggtgactgtagttagcatccatgtattatatatttcaaggtagctagaagacttgaaatgttcccaacacagaaatgataatactcatgagataatggata

SEQ ID NO: 843 - DNA, 147 bp, Artificial Sequence
  Affymetrix ID 3147610
gcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcaccc

SEQ ID NO: 844 - DNA, 27 bp, Artificial Sequence
  Affymetrix ID 3398488
gggtgaacaaatgccggctgagctggg

SEQ ID NO: 845 - DNA, 232 bp, Artificial Sequence
  Affymetrix ID 3629947
gaccagctctgatgggcaacccaaactcaagaagtgtaacttttctgcagaacccttcagaacttaaaagatcactgatgtaaggtcactagctggcacctcttcttataattacaattaaatgggcaataacttacccttacataatgacaactactattaaagagaaatcatggcatttgagaacaatgacataagattaaatcaaggcaccatggctaactattcagga

SEQ ID NO: 846 - DNA, 33 bp, Artificial Sequence
  Affymetrix ID 3677823
ttttgtgtgcgacaactgcttgaagaaaactgg

SEQ ID NO: 847 - DNA, 770 bp, Artificial Sequence
  Affymetrix ID 3101370
taggtgccctgaaagttattgttgctttttttgttttttttttttcagtttgtgcgtgtcacttgaatcagaaaccaaacacatgtaaaaaaatatcatcctcaatgccccccattaactctctctccagaaggtgacaatgttagtgaactcaagactctcactgatgatggtattttacaatgaaaacacaaggaaaccctttgaggtccaattttcacatcatattctccaaatagtaaaatagcagctctacatgttgatgaaaagaaatttcaatttcttcctatttgtttttactcatatcaacattaatatgtatctggatttattaatttccaaaaagaaaattttagttaccaaatatttcagaaatttaataaagcattacatatatgtaattagcacttatctaccaaaaaaacatatgtgtatgtatttatttatcttaccttcactgaagttcttttttctggctggacatgagaaacaggattaagtgatcaatgctggctttatttcttcataagcagtaatttgggtctttttcattcaacacaacgcagcattttcataataaattcacaaaagacaatacaaagaaacacctactgaatagaactctgtcgagcaattcatgttttaaagttggactctataccaaactggcattatggtattataggcatttgatttttgttttcttattttcagtttgtcagtttctttactaccattatttttttctagccggagataacgtataatca

SEQ ID NO: 848 - DNA, 28 bp, Artificial Sequence
  Affymetrix ID 2977512
gccaagattagcatatgtgagtggcaca

SEQ ID NO: 849 - DNA, 157 bp, Artificial Sequence
  Affymetrix ID 2329726
caagcacctcggtatagcattattactgaaaccacttaattcccagctttttgagttttttaaaaaaacccactgcactaagattcacaattcattgctacatacaaattaaagctagtaagaacacactaacgtcacaagtttctcattctaaagt

SEQ ID NO: 850 - DNA, 31 bp, Artificial Sequence
  Affymetrix ID 3626942
tgcatgctcacagtaacacgtatactaaaat

SEQ ID NO: 851 - DNA, 394 bp, Artificial Sequence
  Affymetrix ID 3823576
gcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttc

SEQ ID NO: 852 - DNA, 34 bp, Artificial Sequence
  Affymetrix ID 3837475
cggagcttcctacaatccatcctttgaagaccac

SEQ ID NO: 853 - DNA, 123 bp, Artificial Sequence
  Affymetrix ID 2802804
tcgagtactatgtcttttgtggcactgaaaccttataacactatgatagctctgcttccacagcagtgaaaaccgaaagagccgggctgggcacctgcctctttgaggtggaactcgggtcag

SEQ ID NO: 854 - DNA, 73 bp, Artificial Sequence
  Affymetrix ID 3410550
atatctcgtctaacccctaccattgtgcctggccctttgaaatgtgtttcttgctgacgtgcttgtttctcct

SEQ ID NO: 855 - DNA, 335 bp, Artificial Sequence
  Affymetrix ID 2808525
aaacagagtagcagttcagcccttatttgccttcaaaaaaagaaaagtacaaagtgttctctaattctggcttttagaaagttctaggaagttaaatgaacacttttttttcactatgaattatatgagtgaattcatcagaacggctgcttctaagaaggattttggtggttttagaaaggtaggtgtttattcctttgcctgggaagcctcaccagagatgttgactctacaacccatctcattcgttagtttttgtggacagcagttgcctcatcgggaatttttttttttcacttccttaccatgtttcccttcggatggatagactagcc

SEQ ID NO: 856 - DNA, 207 bp, Artificial Sequence
  Affymetrix ID 3484743
atttacactttaacaacttgctgggaatttaaacaacttgctgggaacatcctttgtgaggcactgtagcctttttttatttgaaactacttaaactccaagacaggctcactaactctttttcaagtgcaacaacaaatgtgttagctgaaaatagctaatttaatgattatttgtgacacagacacgattatgtgagccaagaga

SEQ ID NO: 857 - DNA, 873 bp, Artificial Sequence
  Affymetrix ID 3765643
ccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtaaagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtg

SEQ ID NO: 858 - DNA, 93 bp, Artificial Sequence
  Affymetrix ID 3810029
ctggtctcagctggactatcgctgaacagaggcgttggccgcacatccccttggaaggactctttgcttccacattcggaacactgtcctgct

SEQ ID NO: 859 - DNA, 185 bp, Artificial Sequence
  Affymetrix ID 2658003
cttgaaatttgagcacatcccactgtattatttcactgtatggcaaaagtgaaggaggtaggcatgttctgtcatccttaattaagctttgggctgcttattgaagtatcattttttctatagattggaacatggtttatatagcagactatcttgtccactgacattgcccagtactgagttcc

SEQ ID NO: 860 - DNA, 25 bp, Artificial Sequence
  Affymetrix ID 2788748
atgtagtacatttatgggctgtgat

SEQ ID NO: 861 - DNA, 25 bp, Artificial Sequence
  Affymetrix ID 3242486
ctcagctacttaggcaggagaggca

SEQ ID NO: 862 - DNA, 42 bp, Artificial Sequence
  Affymetrix ID 3540024
aggggagtggatcaaacctggggcaatagtcatcgactgtgg

SEQ ID NO: 863 - DNA, 39 bp, Artificial Sequence
  Affymetrix ID 3439941
tgttgggaagcagcaacaatcagccatacagctttcaag

SEQ ID NO: 864 - DNA, 63 bp, Artificial Sequence
  Affymetrix ID 3457676
ttgtggaggaatacgaggatgaactcattgaattcttttcccgagaggctgacaatgttaaag

SEQ ID NO: 865 - DNA, 680 bp, Artificial Sequence
  Affymetrix ID 3843592
gcctggccagttgtaactatttatcactgtctggactcataaacattttgagatgactttgggagtgcctggggagtttcattcagcctggtgcatatgggcagtgaaaaatatgctcatctgtgatagtagatgtggtttggttcacaaatccaggggctgggctttaaacggcattaggtggacagaggagggttgctacagctgaggtctcagctggtgcagcacaaaagtgaaatagggccatggctatctgaagccatatgtggttctgtgtggctatggagtcattccaggagacgttcacaggatgatttgggattaccactgctattgtaaaccatggaaattctgtgttaatattggatgctatttgtatttgtcaagcatagtctggatgcttatccacattttggtataaggccagaattgaaggcccaatatgatgtgtcactttgacatcttgtgaaagtgggacaaccttaaaaggtgtgagtacaaatctcattcccactctgctctcttgaataatgtatcctagcctaacagcccgttttatcaaggtgataaggcagggttccaggttgttatattttgtggtgggtttcaattccatccctaccagcagagttatggaaacaaaccattgcatattcccaagggaatcatgggccgttata

SEQ ID NO: 866 - DNA, 26 bp, Artificial Sequence
  Affymetrix ID 2518951
gcaaccctgcagtggtagtagtggtg

SEQ ID NO: 867 - DNA, 329 bp, Artificial Sequence
  Affymetrix ID 3187461
cctgggaatattggcgctagagaacagtgatataatttgaggtgtctacaaatgttgtctaaaaaacctctctcctctcatcccatgtttcctctgttctctactcttaaaatctaggtatcactgggaagagtaacgcactaggcccacaggaccttagtattaatataaatgagctttagttttcaaatgtcatttttttctctataactggagaaattccattaataaaagaaccctaggggatagagggtagagggagcgagaggggagtaagggaggacacggacatacttaacactacctagggcacctaaccatcagaaatg

SEQ ID NO: 868 - DNA, 126 bp, Artificial Sequence
  Affymetrix ID 3730738
ggcagataaagtacccatactaaaaagatgtctttagcttggttgaaaaataattgtcagtcctaccactgtgagttcaaagaacttaagaaaatacagaacttcaagcagagatatagaggattg

SEQ ID NO: 869 - DNA, 25 bp, Artificial Sequence
  Affymetrix ID 2898998
gtgagaagagatacattgtgtgttc

SEQ ID NO: 870 - DNA, 40 bp, Artificial Sequence
  Affymetrix ID 3397924
atctaaagagctggtctacctcgtgcagattgcttgtcag

SEQ ID NO: 871 - DNA, 38 bp, Artificial Sequence
  Affymetrix ID 2494772
taaatgactgtggactagtgcgcgttttttgttttcag

SEQ ID NO: 872 - DNA, 78 bp, Artificial Sequence
  Affymetrix ID 3322617
catgacccaccgtacatgcatgggcatgatctgattttttttttaattaaagttgtcacagttatcaaagtctcatta

SEQ ID NO: 873 - DNA, 25 bp, Artificial Sequence
  Affymetrix ID 3735156
taaaattgaaatgcaggttgggcac

SEQ ID NO: 874 - DNA, 29 bp, Artificial Sequence
  Affymetrix ID 2346360
gtattctctttcatgtggtcagtgtatga

SEQ ID NO: 875 - DNA, 842 bp, Artificial Sequence
  Affymetrix ID 3757401
caccagtttagcctttgagtgtgcagagctctgccctccctcccacccctcagccccaaatccaagatttcatagccctaacacccacccaagcagcttccctcacacatgccctttgttttcttcctctcttctatggttccttagggaaaggagccttctttagggatgaaaagctaactacagcccagtctggcctccagcagcccagggtcagctcagcctccactggaggcgagggaggagggcaaagggcatgggagaggtagggctgccctccaggagccttccccttccctaggagccagtcaggattggggaggaaggcagaggggtcctagggagctgtcacatagaggaaaaggggctgggagtggggatgacaagaagtacaaagaaagagaaagtttggggagatggataacaagctcagctgtgtcagtgatgtggaggggaggtatggtgggggaccagccatggccctatccaaccccaggctccacaggccccaaattggctttgcaaatccaaacattttaaggaagtggtttagggatggaagagaaacacggtagaggtctgtgctgtggattttcatctagggtggtgggaacaccagagatgtctcctctgccattgttttagttggctcctggacctcatcccagcagagggagggtgactgtcagcaggtcagtcccaccgccactgtccccctcgcagtgggcctctgtgtctcaggcctggccaggctccctgcccctcagagctcctcgtggacccgctcctcgtcctcatctgacttcagcttgagctcgtcgactgtgatcttgccgtcctgg

SEQ ID NO: 876 - DNA, 95 bp, Artificial Sequence
  Affymetrix ID 2386080
gggcgcttttatgaggcatgagggaggcttgataggggctttgaaggcactgatggcaattggtgaagtagacttttatctaaagggggcagaga

SEQ ID NO: 877 - DNA, 35 bp, Artificial Sequence
  Affymetrix ID 3013608
tttgcctcttcgagcttggcagtgcgagccacaga

SEQ ID NO: 878 - DNA, 25 bp, Artificial Sequence
  Affymetrix ID 3460675
atgaacactcgcaggtggtcaggtg

SEQ ID NO: 879 - DNA, 30 bp, Artificial Sequence
  Affymetrix ID 2564601
cacagcttgggatgttaccttgccttttgt

SEQ ID NO: 880 - DNA, 83 bp, Artificial Sequence
  Affymetrix ID 2939374
tgataatgcctggaaggtccatatcgctaagttctccttactggttggattaatctttggctacctaataactggatgcattg

SEQ ID NO: 881 - DNA, 25 bp, Artificial Sequence
  Affymetrix ID 3320209
ccaccatgattgtgcttgccgggag

SEQ ID NO: 882 - DNA, 105 bp, Artificial Sequence
  Affymetrix ID 3852627
gtgtaacaaccgcacccagtgcgtggtggtcgccggctcggatgcctttcctgacccctgtcctgggacctacaagtacctggaggtgcagtacgactgtgtccc

SEQ ID NO: 883 - DNA, 210 bp, Artificial Sequence
  Affymetrix ID 3349758
aaacaggccatgtgactgaggagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagccta

SEQ ID NO: 884 - DNA, 651 bp, Artificial Sequence
  Affymetrix ID 3427503
aggtccttcaggtgccattaatttttcttgttattcaacacatattattgagcctctgtaatgtcctaggcttgttcaagatgttcagaataaagcagtggatagaacaggctttaaagccctgtactttattgcccaagtcaacgtccttagaatacaggtacctcacaactaccttgaggcttttattatgttattttcttctgcattcaggaattccccagagccaataggatacaattttaaaatgtcaaacctttttagatctcataccatttggcttcagtccttctttccaactgtatcattgtctatttctaaatagggatggtctacactgtaaggctgatttgctcattgcccccacaaaatttgtcttgcattttctctgttcattcctgcacctgaaataattttgccactgccttctcaaagccctcaaaccttcaatgtctgggtcaaagccgttggctcccaggaagcctgttttagaaattaaatccccaagttcttttatctgcattgattatttaacacctgacagttgcaacaactaagatgatttgagcgagataatgctccacattttttaccgtgtctgtgtttgtaggtgtgcccaactgacatactggctaagagttcagggtccca

SEQ ID NO: 885 - DNA, 98 bp, Artificial Sequence
  Affymetrix ID 3835463
gtcctggatcatcaacttggttacaacatggtgttaacatgtgggactgattgtgtttcttgttaatatttctgtttctcccaaccacgctgaatatt

SEQ ID NO: 886 - DNA, 64 bp, Artificial Sequence
  Affymetrix ID 2809576
tcaaatctatggcttaccagagagaagaccagagcgcaatatctccgtggccttagtcctgact

SEQ ID NO: 887 - DNA, 26 bp, Artificial Sequence
  Affymetrix ID 3601075
atgggccaaagctggggcacaggaaa

SEQ ID NO: 888 - DNA, 84 bp, Artificial Sequence
  Affymetrix ID 3864620
gacttatgttttccgggcccagagcgctgaaatgaaggaacgagggggcaaccagaccagtggcatcgacttctttattaccca

SEQ ID NO: 889 - DNA, 45 bp, Artificial Sequence
  Affymetrix ID 3888182
ggaagttctccttttgaacttgtcacgaattccatcttgtaaagg

SEQ ID NO: 890 - DNA, 27 bp, Artificial Sequence
  Affymetrix ID 3558243
cttcgggatcctaatgtgggcagtgct

SEQ ID NO: 891 - DNA, 79 bp, Artificial Sequence
  Affymetrix ID 3702633
tttactcctaagcaccagtgatgacctcgtcaagcagggtgggctgcagggagatgacagcgggtatgaaagggtgtga

SEQ ID NO: 892 - DNA, 361 bp, Artificial Sequence
  Affymetrix ID 3433106
tagctcaatgcaaccgacgtttctgagcccccagaatctgatccagatcccggacatataaaccacgccaagaagacaggggctgtctctagcacattctctcgagggagtccggggccccttcccagacgcaactgcaaaaggaagggctaacgccatggcgggcccgtggtttattttatatccgacaaagtgcacggcagcctgaactggactggaatgaaaagacgtgtctgggacgggtctacggggacgcgctgcgggacctgtccggcttggcttccaagccgctaaccaaccgctggatgctctgcagttcgctggtggccgcctctttctccgcgcagagtttgggcgacaa

SEQ ID NO: 893 - DNA, 28 bp, Artificial Sequence
  Affymetrix ID 3544695
ggggcggggcgtctacctgatcaacaat

SEQ ID NO: 894 - DNA, 635 bp, Artificial Sequence
  Affymetrix ID 3219716
gtggcatctctgcttggaagtcctattcttagtctcagcttcagtacaccctcaagctatcttatttgcttctaaaaatctcttctagtacttctgtttcagtctttgtatagttcctatctgttctttggatattaattatgtatagtcacgtatatatactgtgcagacttatttagaggctttttgtcatattttgcttaaacctgctactgtgcaatcttacattccagttctttcattagtatggtctttttttttcctttctcctctcttctacacttctattctacttttccttcttggtccctttgcgtagcatcttttgcctggccatctcagttttatcttttaagtcctttttctttgttcatcccctgcttcagtgagcttttgcttctctgaactttgataacaagtattactgaaccatttatttctgggtgtagaattcatccaaactgagcttttgagggaaccttattggttatctaattcattctcctggccagtacagctgtcattctctgaaacatccatgacagtatctacttgaatgtttaatggacatctcaaatgtaacgtcagagactgaattccagaccttcctccagttgtctgttcttctcatagtc

SEQ ID NO: 895 - DNA, 27 bp, Artificial Sequence
  Affymetrix ID 3442242
aaggagaaggaataagacggcaggagg

SEQ ID NO: 896 - DNA, 318 bp, Artificial Sequence
  Affymetrix ID 3293761
accctccttaccttgtccttagatgcttaacatttttgtttggttttcttataaaaataacagatcttatgaaggtagaggtcagatgctgaatgagcgtctggcaaaagtgggatctgagcagctgatgcgggctgccagggccaagccaaggttgtccccaaggcctggccttggagggtcccccccgaccggccctgtccctgcccttgctccctgggaggggacggtggatgggtgctgctcacacccacaaggcttccctgtctagtcacagctctgtgatctccaggggggtctccatgatcacgtcgcgaa

SEQ ID NO: 897 - DNA, 48 bp, Artificial Sequence
  Affymetrix ID 3829701
cccaggagaccatcacgaatgcagagacggcgaaggagtggtttctcc

SEQ ID NO: 898 - DNA, 26 bp, Artificial Sequence
  Affymetrix ID 3539958
agtgagaactacagaaggcgaggagg

SEQ ID NO: 899 - DNA, 27 bp, Artificial Sequence
  Affymetrix ID 3620286
ccctatattattctatccgtcctccag

SEQ ID NO: 900 - DNA, 28 bp, Artificial Sequence
  Affymetrix ID 3621069
atgaatccacctaaaaggggcagaggca

SEQ ID NO: 901 - DNA, 199 bp, Artificial Sequence
  Affymetrix ID 2496816
ccacccatgggaagctgatgagttttgtgtattgaattcgaagagcagagaatgggggaaaaggagattcccccattgaaaacctagataatgagagaggcggaaccaaaagcagactcagaacttcactgagaataatgggggtgtagtagtcaggtgagagagactggactaccaaatcatcgttgctatccagtta

SEQ ID NO: 902 - DNA, 57 bp, Artificial Sequence
  Affymetrix ID 2644239
tgaagaccagtcgaaggagtgcagaccaggaaaagcgggacgttgatttggatggga

SEQ ID NO: 903 - DNA, 60 bp, Artificial Sequence
  Affymetrix ID 2832085
tggactttcgccgaaagtgggacaaagatgaatatgagaaactcgccgagaagaggctca

SEQ ID NO: 904 - DNA, 25 bp, Artificial Sequence
  Affymetrix ID 3757844
tgctgaaccctcagcaggagggcag

SEQ ID NO: 905 - DNA, 25 bp, Artificial Sequence
  Affymetrix ID 2943556
cctcatctgctcctactaccttgca

SEQ ID NO: 906 - DNA, 32 bp, Artificial Sequence
  Affymetrix ID 2459948
aaacttttctcgatacccttctgtgatgactt

SEQ ID NO: 907 - DNA, 100 bp, Artificial Sequence
  Affymetrix ID 3119958
ctttgtccgggagaatgtctggacctactatgtctcctatgctgtcttcttcatctctctcatcgtcctcagctgttgtggggacttccggcgaaagcac

SEQ ID NO: 908 - DNA, 107 bp, Artificial Sequence
  Affymetrix ID 2567115
cctgattagcatatcacagtgctctaggagtcctggaacgccttcctcttccatgtgcactgctgctgacatccaggccattttggaacctgcaaatgtctcttccc

SEQ ID NO: 909 - DNA, 348 bp, Artificial Sequence
  Affymetrix ID 2893649
taagtcttagtaactccgtgctggatgtgcattttgcattcagcttctttatcataagggaggaacaaagactggggctcctgctgacatctgcagacacaaagctgagtcggaatttgtggtcttagcttcggttcagcaccaagtgtatttataagtttgcagtcataggttttgttgtccaaatcccaacaaagccctttcccacctccaccccaccccggaagttatatagggttccttgaagggacaaagcctctagaaaaagaaaagtcactgaaagttgtaatgtgaaaccagcaaagagaaaatacatgtttggtttagttgtggtcacagtccatggtg

SEQ ID NO: 910 - DNA, 30 bp, Artificial Sequence
  Affymetrix ID 2346547
ccctgacagatctcggtctggggcacagga

SEQ ID NO: 911 - DNA, 990 bp, Artificial Sequence
  Affymetrix ID 2852745
ctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaata

SEQ ID NO: 912 - DNA, 654 bp, Artificial Sequence
  Affymetrix ID 3659213
acctccaaggttacagcactttctaagaatgtgcctatgtagcatgtctgtccccccactgcctccaccaaaattctgagaacaaagacactgtagggattgaacctgaagagtattcgctggaatggtatgctaaggtttctttcctgctgtacacctcctctgccccaacaaggtgctttaagttctgttttttaatttaggaaacctgttctgctattatagaaggccatgaaaagagaccagtgatttatctaatcataagcaaaaatagtagaaggctattgtcttgtcacttaagttgaatgaatcccagtgattgtagttgcttcacgaaaaataaccaatttgttctacagaggtagtctgttcccagagattgaaaaaaaaaaagatgtaggaaagtttaaataaataaaattgtttaaattcacaatggagggccaattcacatggccctctgcattttgatgtaattctaacagttttactagcagaatctaacaaattttgaaagtcagagcgtatgtatagatatatatacacatgcacacatttttttaatgatacgttatccacttaaaaaaaaaagtctcaagaatgtcataagaaactcccttaacctcaatgagcctcaggtttctaatccctaaa

SEQ ID NO: 913 - DNA, 202 bp, Artificial Sequence
  Affymetrix ID 3296517
ctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatgg

SEQ ID NO: 914 - DNA, 25 bp, Artificial Sequence
  Affymetrix ID 3028090
cttggtcgtcacattctgcttttag

SEQ ID NO: 915 - DNA, 135 bp, Artificial Sequence
  Affymetrix ID 3291113
aagatctttgagttgtacttggtgtgtgctgtttttgtttgagatgcagtgaatgtgcaaatagcccagccgtaaatagttacttaaaataatctcttggtactgggtagcagcagtagaaagttgatctgttta

SEQ ID NO: 916 - DNA, 80 bp, Artificial Sequence
  Affymetrix ID 3616816
gggccgaaactgctgccgtgcattagctctgtggaggggagtcataaattctggttgtcagcgttttccgtggctttgtg

SEQ ID NO: 917 - DNA, 146 bp, Artificial Sequence
  Affymetrix ID 3842744
ctccatatattagctggggctgccataacaaaacatcatagactgggtggcttaaacaacaatttacttctcacagttctgaagtctggaagtctgagaacaggtcgccagcatggttaggttctcgtagggttctcttcctgttc

SEQ ID NO: 918 - DNA, 29 bp, Artificial Sequence
  Affymetrix ID 3956320
tcccgagggctccttggtgtttcatgaga

SEQ ID NO: 919 - DNA, 354 bp, Artificial Sequence
  Affymetrix ID 2473315
ctgggctgccaatctcttgccttgggggcagagcctcatctctctggctactggggttagctaccttgttggagctggcaaagccattggtgttgacatcgggggtgactcctgaagccgccatatacgtgctgccaatggttttgatcttggtgatcacccggaacttgggattgtccaggagctgaggccaggattcaggaaagaattgtcagcagtcaagggagaggaatgacccaacccagtgacagatgtacctgtttacaaggaccccactaaacccaagagacactttcctatcaaagttgttacttagtctaccgcttatctgccacatgatcctgggagaacttc

SEQ ID NO: 920 - DNA, 197 bp, Artificial Sequence
  Affymetrix ID 2659117
tgcctacatgctccttctagctttgtttccctgatgttccttgccacctgctactcctctctgagctacttttccaggttccacagggagaggttcagctgtccgtggtagacatgagggtagagaatgaggtggttgggttccacttacctttctatcatcttgcagtatggatgtctcttgactggtaccgtgta

SEQ ID NO: 921 - DNA, 26 bp, Artificial Sequence
  Affymetrix ID 2826873
gatatttatttgggtgcatgtttcct

SEQ ID NO: 922 - DNA, 134 bp, Artificial Sequence
  Affymetrix ID 3498544
tggcgtctgatcaggaagggactctgctgcggctgtggatctgacctgggtatcagatggtgatgctttgtaaatagtgtgcctcataggggtctgttcttagttaaaaggagcctgcttggtgattccttttg

SEQ ID NO: 923 - DNA, 126 bp, Artificial Sequence
  Affymetrix ID 2756844
caggccatcgcctactcattgctggccgggctgcagcccatctacagcctctatacgtccttcttcgccaacctcatctacttcctcatgggcacctcacggcatgtctccgtgggcatcttcagc

SEQ ID NO: 924 - DNA, 25 bp, Artificial Sequence
  Affymetrix ID 3088854
atgtgccctacccagacagtgcctg

SEQ ID NO: 925 - DNA, 1187 bp, Artificial Sequence
  Affymetrix ID 3173548
cgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcgga

SEQ ID NO: 926 - DNA, 53 bp, Artificial Sequence
  Affymetrix ID 3200057
tccctcccaaccagtcccatcattccaaccagtggtaccatagagcagcaccc

SEQ ID NO: 927 - DNA, 94 bp, Artificial Sequence
  Affymetrix ID 2974443
ggccatgagagtctggtgcaccacatcctgctctatcagtgcagcaacaactttaacgacagcgttctggagtccggccacgagtgctatcacc

SEQ ID NO: 928 - DNA, 91 bp, Artificial Sequence
  Affymetrix ID 2385905
tctaaaaggcgtggaaacatttataagaaataccaattatgcagtgttggtgtcagtgtggacttaactgccgagactgacttattgccag

SEQ ID NO: 929 - DNA, 169 bp, Artificial Sequence
  Affymetrix ID 3639566
acaggttatttctatggacaggctcttgacagaaactctgaacatggatattactgtccccttcattcaaatgaggctgaactgaggctcataagtatttaactctcacacctagttaacacagtaagatttgaaaccagatatatatgaatccacgaagtcttatctg

SEQ ID NO: 930 - DNA, 31 bp, Artificial Sequence
  Affymetrix ID 3200565
tggcatttcatgaggggaggcttatctgtgg

SEQ ID NO: 931 - DNA, 90 bp, Artificial Sequence
  Affymetrix ID 3083781
atgtagtggcctatgttgaagtgtggtcatccaatggaacagaaaattattcaaagacatttacaacacagcttgtggatatgggggcaa

SEQ ID NO: 932 - DNA, 26 bp, Artificial Sequence
  Affymetrix ID 3829376
atggccgtcgtcaggagcattgtgga

SEQ ID NO: 933 - DNA, 34 bp, Artificial Sequence
  Affymetrix ID 2359017
gtaaccgggggatcttgcttgtcagtgcctggac

SEQ ID NO: 934 - DNA, 397 bp, Artificial Sequence
  Affymetrix ID 3180982
ggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaa

SEQ ID NO: 935 - DNA, 131 bp, Artificial Sequence
  Affymetrix ID 3915249
ccaagctgtagatcttcccaagatatttttcaggaacgaagcatgtaaacttacatgagtgaaagacagtggtaaaaaaaaaaaaaaacagtctattttgggctttggctcctacctaaatctagcttgtt

SEQ ID NO: 936 - DNA, 144 bp, Artificial Sequence
  Affymetrix ID 3263765
tgcagagtcctacagctggttcaaggcagcatcaggctcagaacccctttctctcagctctctgttgtgattatttcaggaccttgttctgttttccacatggcctctaatctagacacctgacctggtgggagtaacctttca

SEQ ID NO: 937 - DNA, 85 bp, Artificial Sequence
  Affymetrix ID 3303272
ggagctcaaaaagtaccaggccattgcttctaacagtaagatctattttggcagcaacatccctaacatgttcgtggactcctca

SEQ ID NO: 938 - DNA, 266 bp, Artificial Sequence
  Affymetrix ID 2683681
ggtgacccaggcacgatagctaagaaggcaaagtcgcttgttctattagctgtttaggcatctttgcagccatccttgatttggagtttttgatcttgatctaattctatccctcaaaaccagcccttacaatctcacgtgcccacctcttccatgacagtccttgggcctagagggagggtgattgtatagttttagcagcagggcatttgcagtgaaaaacagattgggcccagtgggatgccaaatgagagagggtcgcatct

SEQ ID NO: 939 - DNA, 81 bp, Artificial Sequence
  Affymetrix ID 2683865
tggtgtgtggcttcatacatttggggaccctatttccactccctcctcttggcatgagactgtatacaggatccacccgag

SEQ ID NO: 940 - DNA, 57 bp, Artificial Sequence
  Affymetrix ID 3781116
ggcagctgccctgtaatgttctaccagtacttcagactcaacatgcacgaagattaa

SEQ ID NO: 941 - DNA, 129 bp, Artificial Sequence
  Affymetrix ID 3050281
atgctgcccttcgatgaccatagtgaatgttccacagagtgtactacgagccacaaacaccagggagagaaccccagcatcagtggagtagaaacaaaaaggtgttctgtgtttcgcacttgggtcctg

SEQ ID NO: 942 - DNA, 378 bp, Artificial Sequence
  Affymetrix ID 3903591
atcggcatagcctagatgggtcttctgtttcagggtctctcacaggaggtagtcaaggtgtcagccagggctggtgtctcatcttagcgcttggctggggaataatctgtttccaaactaacttggttggtgacagaattctcttcttgaagggatgttgaattgaagggcttggtttctcactggctgatggctggaggttgctctgaattcctttccatgtagcttcttcaacatcacaaagctgagaaaggaatagcaagtctcctaggaagatggaaatcacaattttttataatcatggagtggcatcctatcacattttccatagtccgttagttagaagcaaatcaccaggccagtccatactcaggagga

SEQ ID NO: 943 - DNA, 96 bp, Artificial Sequence
  Affymetrix ID 3115066
gtctaggggttacaggatcatcatctaagttctgcttctgcctggacttgctgcgtaatttgaatgagtggctaaacctgactctttctcctcttg

SEQ ID NO: 944 - DNA, 50 bp, Artificial Sequence
  Affymetrix ID 2509773
cactaacagaaggtttggaagcctacagccgtgtccggaaaaggaacaga

SEQ ID NO: 945 - DNA, 27 bp, Artificial Sequence
  Affymetrix ID 2322410
ttctctttggtggtttctaaagtgcct

SEQ ID NO: 946 - DNA, 85 bp, Artificial Sequence
  Affymetrix ID 2837342
ttttgtgcggactgccattcctttcacccaagaaccacaacgagacaaacctgccaacgtccagccttattacctctatggatcc

SEQ ID NO: 947 - DNA, 104 bp, Artificial Sequence
  Affymetrix ID 2936910
ttaaaggtgtagagtaagaagaatcaataccgtgtgttggatattaagcaattggtaattaatcttgcttcctttatcttgacaagatgtgctttttcacttac

SEQ ID NO: 948 - DNA, 130 bp, Artificial Sequence
  Affymetrix ID 3958553
atccttcaagccagacttcatcctggtccgccagcatgcctacagcatggccctgggggaagactaccgcagcctggtcatcggcctgcagtatggagggctgcctgctgtcaactctctctactccgtc

SEQ ID NO: 949 - DNA, 50 bp, Artificial Sequence
  Affymetrix ID 2901722
acagtaatggaagacgggagttgcagtgctcagtcatggaattcctccta

SEQ ID NO: 950 - DNA, 40 bp, Artificial Sequence
  Affymetrix ID 3092902
ccaaatgagtttactggtgatcgctgccaaaactacgtaa

SEQ ID NO: 951 - DNA, 501 bp, Artificial Sequence
  Affymetrix ID 2437102
tgccacgtgctcagaaattcacagcagatgcaatctcatgtaaaaccctcatgtggtaaaacaaagatctatcatggttgcccttaatcttttctcttttttttttttttttttttttgagacaaggctttactctgtcgcctaggctggagtgcagggatgtgatcactgaagccttgacctggtctcaagcaatcttccctcctcagtcttaccagtagctgggactaccagtgagtgccaccacacccagctactgttttaagtttttgtagagatggggtttcaccacattgcccaggctggtctcgaactcctgggctcaagtgatcctcctatttcagcctcccagagtgctggaattacaggtgtgagccactgtgcctggctgccctcatttctttgcccccctctaggacttgctttctccgcatagcccttttgcaggcttcagagttctttccatccagtagccccgggacttctctctgttaggttttg

SEQ ID NO: 952 - DNA, 26 bp, Artificial Sequence
  Affymetrix ID 2657991
tatgccgagattttgctgtcctggag

SEQ ID NO: 953 - DNA, 96 bp, Artificial Sequence
  Affymetrix ID 2520359
ctttgagcgatgaaaacagtttttatctttttagcaaagttgtagttaggatcttctgtctgtttttaggggtctccactggtattaaaggcctga

SEQ ID NO: 954 - DNA, 183 bp, Artificial Sequence
  Affymetrix ID 2592274
gctgaggtttagctgtcagttctttttgccctttgggaattcggcatggtttcattttactgcactagccaagagactttacttttaagaagtattaaaattctaaaattctattaatctctcattaatagtatttaatataaagattcttaaaattactgacgttatgaattggtttgatgc

SEQ ID NO: 955 - DNA, 222 bp, Artificial Sequence
  Affymetrix ID 2681309
atcttctaagtgtccatgcagcttgaatcattgcacacagtcttctatgagttatgaaaataaataaaaccccctcttttccccattttatggttgtgaaactgacacagataacacaaaagggtagattagggaaagccatatcccctctgccacccacctccaatactgatccagctttcctggatcaggctagtagggcgttgaggcttcttactagaa

SEQ ID NO: 956 - DNA, 165 bp, Artificial Sequence
  Affymetrix ID 2961267
ttggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaa

SEQ ID NO: 957 - DNA, 1388 bp, Artificial Sequence
  Affymetrix ID 2854242
ggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttg

SEQ ID NO: 958 - DNA, 417 bp, Artificial Sequence
  Affymetrix ID 2957263
tggggaggcacataacagttttttattctgggaagagccagttccccactcaacatattcaataggcacagagaccaggggaccacggaaagctccagtgacccccgacccccgccaactcttcctaacaacatttgactccttgccctcctccgttggaactgtgcttcctggaaggaaagtgattgaagaagaagagatgtagttctgtaaaaggcataaaaacagcttgtttttttaaaaaaataatatttttctgttatgatgcaaattttttcatgactcttctttctctcactctccacagtcatttcatcggcaggtcctgccagctctgcctcccaaacacattgagactgtctgctgctttctgcctgcaccaccaaccctagtctagtgacctttgaccaggggaga

SEQ ID NO: 959 - DNA, 29 bp, Artificial Sequence
  Affymetrix ID 3429874
aacagaagaatccgtaacagaagatgaca

SEQ ID NO: 960 - DNA, 159 bp, Artificial Sequence
  Affymetrix ID 3766915
ctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctga

SEQ ID NO: 961 - DNA, 251 bp, Artificial Sequence
  Affymetrix ID 2691040
cgcactggcattggaacataataaactaaaattaaaatgtttctttactgtgcctcaccattgcacaatcaaaaaaaatttttttgcatacactgtggtgaaataatttttaaaacttggacttgctactgtgaagactgatgtttaaagtttataactgtataaacattttctatgtccccccccacaccatggatttcttataacattggatatatttttccttgctggactattctcttttggattga

SEQ ID NO: 962 - DNA, 2946 bp, Artificial Sequence
  Affymetrix ID 2824389
agtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttacca

SEQ ID NO: 963 - DNA, 65 bp, Artificial Sequence
  Affymetrix ID 4054485
ctctgcaggatcgggatcagagcgtgggaggaggtgggggtggacgtccatccggtgaacagtga

SEQ ID NO: 964 - DNA, 75 bp, Artificial Sequence
  Affymetrix ID 2871027
cccggcctgatcagaatgtgacaagaagtcgaagcaagacttaccctaagcgaatagcacaaacacagccagctg

SEQ ID NO: 965 - DNA, 186 bp, Artificial Sequence
  Affymetrix ID 3468170
gctgagcccataacctgcgtcttctgctctagcctcttgtctgtctcattcctcctctgcatggattgtctctatttggaaggtccgtggtttttatgtgtaaaatgaaagctgccgtgttccctttccaacaccaagtctagttctctagctcccattctatcagtgtcatacctcccagcttaa

SEQ ID NO: 966 - DNA, 84 bp, Artificial Sequence
  Affymetrix ID 2739471
gatactgcattcaaacgaaacatgtggccattctctgtgcggtggtggtgggtgtaggattaatagtgggacttgccgtgggct

SEQ ID NO: 967 - DNA, 30 bp, Artificial Sequence
  Affymetrix ID 3725508
ccagtgctttgcactgtagctgctcaataa

SEQ ID NO: 968 - DNA, 774 bp, Artificial Sequence
  Affymetrix ID 3946498
ttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaa

SEQ ID NO: 969 - DNA, 33 bp, Artificial Sequence
  Affymetrix ID 2818169
agacacagacgggtggacccaagcattgagggc

SEQ ID NO: 970 - DNA, 42 bp, Artificial Sequence
  Affymetrix ID 3092610
ttttgctttgtggccggattttgctactgcttgctcttctta

SEQ ID NO: 971 - DNA, 101 bp, Artificial Sequence
  Affymetrix ID 2560754
gcccgctatctgcatctgccttttggactccttgggggaaataaaacaatcgtgtacagttgggaggctcttcgttttcaccatcagttgactccatcagt

SEQ ID NO: 972 - DNA, 132 bp, Artificial Sequence
  Affymetrix ID 3850324
gagttcagggagacgccagacaattgcagcagtttgtagagttatgtgggtcaggctaggattagttttgctgcaggaataagcaatccccccaaatcttaatcaaggtttacctaaaatcggccgagcaca

SEQ ID NO: 973 - DNA, 34 bp, Artificial Sequence
  Affymetrix ID 3209807
cttctctgaaaagaccagcggccctatgactatc

SEQ ID NO: 974 - DNA, 890 bp, Artificial Sequence
  Affymetrix ID 2639722
ccttcttctctactgggtgcaattcgaggttgctgagcttctctccaaagtctaaaatggtggggcagtagggacctgtgagaggcccaatggcccaatgtacttcccccagatcccactcagaacagcaggtacgcccaggctcctgctgccctagaggtctgcaacatgagtgaagaggttaattagagggacacacttatctctgaagtttttctccaggctgaacatttctattatcagtggcccctaatctggaaaaacccatcattctaatctagcttgtatccccacatcatgagaaagagggaagaagaagaagggatgatgtgtggtagagaagatgagggttaactttagcctttcccaaacactggcaacaaccacttcctcaacaatttttctatttgcttcagcctactcagattttttcaggtttttctagctcctccataacctcactccctcccgaggtctctggttcaaagaccaccctaccagcccctatttgcttcaggttatcctgttgagggtgggtgggaagagtgagaagatataaatgaaaaactggccacatgttgataattgttgaaactagatgatggtacgtggacattcattataccattctccccacttctgtatttgtttgcaatttttcataataaaaaagttttaaaagtcctccagtttccaacacactcaagagagagccccaaccccaaacacagagtttcatggaaaccccacaccaaggcaagaggcagagatgatgattccatttcatatatacactcattttctaactttttttaaaggcccactgctttattttcaatagattaaacctgatttctgagaggtcctgaagttgggcttatttccctggc

SEQ ID NO: 975 - DNA, 25 bp, Artificial Sequence
  Affymetrix ID 2972483
gtgatgactatgggccaggacaaca

SEQ ID NO: 976 - DNA, 31 bp, Artificial Sequence
  Affymetrix ID 2518314
gcagttggtgcttttcggtctgattctgctg

SEQ ID NO: 977 - DNA, 29 bp, Artificial Sequence
  Affymetrix ID 3680796
tgtctgcttcaacctcacacttctctcag

SEQ ID NO: 978 - DNA, 105 bp, Artificial Sequence
  Affymetrix ID 2329274
ctgtgggaaggactcttctaggttttggactctctaattcttctgctgaacccagtgactgtgtaaacatccagaggcccaccccacccaaagaatgtcagactg

SEQ ID NO: 979 - DNA, 67 bp, Artificial Sequence
  Affymetrix ID 3379673
ttcaggcagcaagagccggcaacgccatccatgccatcctgctttacaggcgcaaactggaccggga

SEQ ID NO: 980 - DNA, 25 bp, Artificial Sequence
  Affymetrix ID 3549257
tgagtcctccattccaaactctcct

SEQ ID NO: 981 - DNA, 66 bp, Artificial Sequence
  Affymetrix ID 2360474
gacatctagggcctctgaactttctccggggcgcagcgtgacggctggcatcatcattgttggaga

SEQ ID NO: 982 - DNA, 27 bp, Artificial Sequence
  Affymetrix ID 2584988
aaaataagatgcgggagtgtttccaaa

SEQ ID NO: 983 - DNA, 91 bp, Artificial Sequence
  Affymetrix ID 3630231
tcacatgcaaatggttacggagatcgtggtacccactgtctgctccctctgtgtcctcatcactgctgttctactaatgctcctcctgagg

SEQ ID NO: 984 - DNA, 57 bp, Artificial Sequence
  Affymetrix ID 3801606
ctggtgccagggctcctctcactgccctacacttgcagggaggtggacttccctccc

SEQ ID NO: 985 - DNA, 385 bp, Artificial Sequence
  Affymetrix ID 2476381
agcatcacatattcaggggaccttgaaaagtttggtgtgcctgagcatagtgtagctggaaggtagtggtgggagatgagcctggagaggaaatcaggggctagaagataaacaggaatatatcacagagttacttaccttaaaagtaatgttgagccactgaaaggttttcagcagctctcatcaggtttgcattatagaaagatggtcttcaggtgtagttgaatggttggaggggaagttggaacaagaccaaactaccatggaagagactttcatctgttttgtctcagcagatagagctgtatatgtcttctccctgtcctactgttttgggggactgagattttggtactcatcagcactcttgctctcatattatgga

SEQ ID NO: 986 - DNA, 176 bp, Artificial Sequence
  Affymetrix ID 2522188
ggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagc

SEQ ID NO: 987 - DNA, 44 bp, Artificial Sequence
  Affymetrix ID 2673516
atgccagtgtggtacgtgagatctgctccaagtacatctatgac

SEQ ID NO: 988 - DNA, 25 bp, Artificial Sequence
  Affymetrix ID 3659195
gaagaagcagtgcatctgggtggca

SEQ ID NO: 989 - DNA, 483 bp, Artificial Sequence
  Affymetrix ID 2652475
tctgtccctctgctagttagttctgtacagttatccccacagtcctcttcctaaagtagacattactttcttgttcaggtctagagttggttgccttcgcatgtagttaaagttctgtagcatggtgtataatatccataacactcaaccctgcttacctctcaagaggcacctttacctgtcaccccacagtctatgtgttaaatttctgttccctagataccttgggcctctttctaaatacacactttcatgtccattatttccccctgtctggaatactctagagcctttcattgacaattcacttgttctttttggtgcccctcctcaatgtgacccttttagaaccttcatcacagaaatagttgttctgttttttcagcatctgtgattctttccctccctgtcatagaataaaatgtgtatttatagtcatcaccaagaactcatattgcctcatggggattgtatctcagcatc

SEQ ID NO: 990 - DNA, 28 bp, Artificial Sequence
  Affymetrix ID 3198107
atgaagcagcacaggtacgaggtgcaag

SEQ ID NO: 991 - DNA, 26 bp, Artificial Sequence
  Affymetrix ID 2994022
gtagattcgatgggcccgaggctcag

SEQ ID NO: 992 - DNA, 129 bp, Artificial Sequence
  Affymetrix ID 3548367
tcctgttttctgcattagctgtttgcatgtatttagtaggttagaggtgggaactagagatcagagaattgtttatggcagcagagttagcagtaacttgagagggcatagctaagtcaaagacctact

SEQ ID NO: 993 - DNA, 108 bp, Artificial Sequence
  Affymetrix ID 2440185
ccaaaaaggtacaggtgcccaactgtgatgagatcttctatgctggcacaggcaatctcctgcttcgagatgcggactctatcacactctttgacgtacagcagaagc

SEQ ID NO: 994 - DNA, 34 bp, Artificial Sequence
  Affymetrix ID 3480073
atggggcttatccttactcgcagtcacctaaaag

SEQ ID NO: 995 - DNA, 25 bp, Artificial Sequence
  Affymetrix ID 3513910
ggtccaattgagtgctgtccaggca

SEQ ID NO: 996 - DNA, 25 bp, Artificial Sequence
  Affymetrix ID 3978139
gaaggcctcggcaaaggactgtgct

SEQ ID NO: 997 - DNA, 25 bp, Artificial Sequence
  Affymetrix ID 2540091
cagctccagggtgaaatggtgctag

SEQ ID NO: 998 - DNA, 119 bp, Artificial Sequence
  Affymetrix ID 2896688
tcccgagggctgatcactggaaacagggcaacctctggtgacctggtttttcatcaccagccagggcagaagaagtcaaagtgtgctcaagggctttgcacgctgctccctagaactgg

SEQ ID NO: 999 - DNA, 38 bp, Artificial Sequence
  Affymetrix ID 3022504
actgtcttggtgttggtcaggattaatataagggagtg

SEQ ID NO: 1000 - DNA, 38 bp, Artificial Sequence
  Affymetrix ID 3104044
atggcctgaaagctttaggtggtgcaacacagggtgaa

SEQ ID NO: 1001 - DNA, 1180 bp, Artificial Sequence
  Affymetrix ID 3939535
caatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgtgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcc

SEQ ID NO: 1002 - DNA, 999 bp, Artificial Sequence
  Affymetrix ID 2420794
tagatctccacatgataacctgttgaactttttgagtatctgttgatcaagaaaataaagtcaaaagctacaattaattagtaatgtgctcaaaataaatttgtattttataaatcataacatcttttccatgttactctgtctatatggagttcttaataccacacatttgcttagggagatggaattagcaactagtctgtgctaccctgtattttttttttaaccatgtagttggattttttaaaatacaataaaagagttcacttttccaggtttgacaacatttttatgaattggaaattttctgtggctacagatactattaacattttggaaaggtgtaaagaacattgttttaatgtaaggctcttctctaacctccctcccctctccaaattctccataatatgaagtaggaagatatgtatttttctgttgccattaaaatgttctggccatcgtgggagtggggatggggagggcggggatgggaattagaacttactagaataaaattccaaatagaggtttggggaaacctacttgtgagtgctttttaacctcaaaataaggatttggggtgggtggagaaggtgatggggcagaagaagttgtttttggaggagagaaagcagattgaaaggaaaaggacagctgatagccacttaaataatgtcatcgttagagtgatacctattttttgtaaaaagaaaacaatatgctccattcttacaaagcattgattgtattttaatatatacaatgtaaatactatcatgcagtggtgtccaagggagagaatacagtcatgagttcttagtttctgttattggttgggccaataaagccccttcatcatccttcttttctgcttatcactagagacagaaactaaaaaccatggcttcaggctgctaaaagcctaaaacaaaacagaacaacaacaacaaataaggcaggttggacaagcttgctgagtatttgggagcctttttc

SEQ ID NO: 1003 - DNA, 280 bp, Artificial Sequence
  Affymetrix ID 2444781
taatggggccaaaggggcaacacaaagcattgaaaacatcactggctcacaaaaacagtcaccttgttaccttctcagttgcatttgtttatttcacaaggcttcattcacacataaaaacaagatactaatccaattcaagttcataacgattataaaagtaaacatttgttgggacaatgtacaataaattgcactttttagacaagcattacatttacatttatagagtgtactatacataatacatggaattacggaaacgtctaattggtcattg

SEQ ID NO: 1004 - DNA, 139 bp, Artificial Sequence
  Affymetrix ID 2537266
tgatacacttctgaaccacagccagggtccaggcctgaacagatgtcagcatcttcagggagcttttgccaggacgccgcccagccacatggccaccacgttcattcaaacacggggcttcctgtcaaactacactaga

SEQ ID NO: 1005 - DNA, 269 bp, Artificial Sequence
  Affymetrix ID 3061935
aagaggtcacccttgccgtttgatggaatgcctattatttgatagctgctgataccacgataacacagagattccctttcaattaaaagtgcctggacaccacagccagacaacttctgtcccaccacatgtatactgaatttcagtcttcttacatctcatttcaaatatattttgaaatatatttccagtttatataaatagtataacacctaacaattcccatttatttgcaaatattattgtgaggatcgactgggacataaatg

SEQ ID NO: 1006 - DNA, 310 bp, Artificial Sequence
  Affymetrix ID 3893061
ttcctgtccagctaaagatgctgcctggccgtggcctccacgctctgtaaacatgacccacaccccccagggcactccacggaagccttggagataagggacacatcacttctatgctcacctgaagtgaccccattgttaaaggacacagctcaactcaatcagggcaccagcagcgactccaagtcagggtgcaaactctggaggctgctgtgtgaggggggcactagagatggtggtaaacagaaaggggggcttccttcaccagccaggtgaccccaggcaagtcacaaggaaccgctctgatcca

SEQ ID NO: 1007 - DNA, 32 bp, Artificial Sequence
  Affymetrix ID 3996137
ccatggaatcctgttggagctggtctacagaa

SEQ ID NO: 1008 - DNA, 140 bp, Artificial Sequence
  Affymetrix ID 2424640
tgggagaattgttgctatgcagtttgttcggacagagcaagatgaaactggaaaatggaatgaagatgaagatcagatggtccatctgaaagccgatgtggtcatcagtgcctttggttcagttctgagtgatcctaaag

SEQ ID NO: 1009 - DNA, 292 bp, Artificial Sequence
  Affymetrix ID 2823618
ttcctgctactggttggttaatgaggcactgagctaggaaccctgtaagtgttcaagtgttaaaattgtgttgttgtacctttaaatataaggagaagaaattgggagagatcagattaaaatattaaatacttatatggtttagaaaagtgacagcataagggagatcaaccaggtttaagggtaaatacttaggtgaccagaagatctacagtaaacttgaggacatatcccaccaagacccacaactcagctccagctgattgtttccacaataggactgaatgcctgc

SEQ ID NO: 1010 - DNA, 135 bp, Artificial Sequence
  Affymetrix ID 2491474
atctggcgtggagatcgttcaaaggtgggaaactacgggaggaaggtactcaggtgttgagtgcagccatggggccacttgaattagcatccaggcagcccgcgcccctccccagagacaatcagcggtgtttca

SEQ ID NO: 1011 - DNA, 61 bp, Artificial Sequence
  Affymetrix ID 3780190
cccatgatgtctgtcgtgcagatgaatgtgtccacgcgtgctgggctagtacagaagatcg

SEQ ID NO: 1012 - DNA, 214 bp, Artificial Sequence
  Affymetrix ID 3443271
ccacagtatggtcattcagcgaaagaagtaccaagtatttctttctgttaatgagtcagaggtattaatatatgtatgtgagtcccccatttaccctgcgcaagataagttcttttaaatgcaattagaatatcctaagataaattacaaactcctcttatgtatccttttctctgaggtgaaatgagacactgcacagatgagaggtactatt

SEQ ID NO: 1013 - DNA, 76 bp, Artificial Sequence
  Affymetrix ID 3249840
gcactgaacgctaatccctttttctatttccgcttctcacaggcacaggaacacaggcacaaatgcacaccacaca

SEQ ID NO: 1014 - DNA, 616 bp, Artificial Sequence
  Affymetrix ID 3365366
ggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgttt

SEQ ID NO: 1015 - DNA, 92 bp, Artificial Sequence
  Affymetrix ID 2883453
ctggctgtatggctgcatgtgacaagccacgtcccctcccacctctccccaaacccctgcatccctgtattcacacgggtcactctgactca

SEQ ID NO: 1016 - DNA, 63 bp, Artificial Sequence
  Affymetrix ID 2924473
agcagggactcagcgtgaggcttgaagcaaacagtggaatctttagaagcctgctttgtgtgc

SEQ ID NO: 1017 - DNA, 348 bp, Artificial Sequence
  Affymetrix ID 3378661
ccctgggtgtaacgaggccattttgcaactacatccagccaggctgaaaacacttactttattccgagtccatcagaattcttgaaaatcagaggatctctcaagccaccccgctgaatatactctacattaaaatctgtcaccataggaaaatattagaaagataagtggtataattaaaaacgataaaaggaccataaaaaggatcctaagtaatacagtataaatggtgtttgttattctgtgtatatagttatgctgttagtcaataaaatatatgcttagtaagaagcatctcttagaaaatatggagagcacattgagaagcaacgcttgaggggttttcca

SEQ ID NO: 1018 - DNA, 33 bp, Artificial Sequence
  Affymetrix ID 3754749
aggctgggtgtcctgtaccagaatacataaaag

SEQ ID NO: 1019 - DNA, 25 bp, Artificial Sequence
  Affymetrix ID 3150460
gctgcccacgggactttgcaggagg

SEQ ID NO: 1020 - DNA, 112 bp, Artificial Sequence
  Affymetrix ID 2664515
ttctctttagacttaccagttaggctctaatttaggaaaaataaaacaaaaacttacatgggtttggagtaaaattagctggagtaaaatccaaggctagatttctattgaa

SEQ ID NO: 1021 - DNA, 25 bp, Artificial Sequence
  Affymetrix ID 3123616
aggagggcccaatatccctgggtcg

SEQ ID NO: 1022 - DNA, 48 bp, Artificial Sequence
  Affymetrix ID 3432252
agtggtcaaacccagatgagggtcccgcttctggtttatatacaataa

SEQ ID NO: 1023 - DNA, 33 bp, Artificial Sequence
  Affymetrix ID 2593632
ggagcgggaaggagattgactgttagtttctta

SEQ ID NO: 1024 - DNA, 83 bp, Artificial Sequence
  Affymetrix ID 3054956
tgtgccagccacagtacgatgtacctcctccaatctatgtgtccaaatcagcgcatcctttaaggccctactcagatggcacc

SEQ ID NO: 1025 - DNA, 99 bp, Artificial Sequence
  Affymetrix ID 3096135
gggacccagaagcaaccgttatgagcaacaaaaggaagacactggtttggatggacgggaagcggttgggtgggctggactgacggaggcccctttaga

SEQ ID NO: 1026 - DNA, 399 bp, Artificial Sequence
  Affymetrix ID 3541539
tgtgggctggccatctatatccatccatctatctattattccacccatccctccatccatccatccatttatttaattaagttatttttaacggttggctctggagttgacattcatttattttaaaagaacagtgaatcatagctcttttcctcaagatgcttgcttttatttgcatggtggcatattgattaagtactcagaacactatttgacatatggtaagccctcaataaaagtttgttattattatgactgtacttctcccctctaatgtatagaggtaaacattttggttcctattgtgacacgtgggttataatgagttagggcctacttaagaagaaagtggaaagaaagcgggtaaaattgttgctcagatactagcatgtgggtgga

SEQ ID NO: 1027 - DNA, 89 bp, Artificial Sequence
  Affymetrix ID 3762591
ggggcggtggtcattaattctgctatcttagtatctctctctgttttgctgcttgtgcacttttctatttctaccggtgtgccagctct

SEQ ID NO: 1028 - DNA, 27 bp, Artificial Sequence
  Affymetrix ID 3305557
acctgccatcctcatagtcaccgggag

SEQ ID NO: 1029 - DNA, 100 bp, Artificial Sequence
  Affymetrix ID 2394713
tggcaaaagagcaatctggatccgccttagccagatacataagggtatttgccttcactttcagccagcattccccccagcgatcctagccagatattac

SEQ ID NO: 1030 - DNA, 122 bp, Artificial Sequence
  Affymetrix ID 2406204
ctgatatgtatctgttgggcaagtagttccatgaggagtttgtttttgttcagaatgatctttaggaaaaatggaaataccacggtgaagggaaagaagtcagaatatgtacacaaagccta

SEQ ID NO: 1031 - DNA, 73 bp, Artificial Sequence
  Affymetrix ID 2722321
tgtttttcccgggatacatctgtgttgagtcactttgcattcaacagtgcctcgccaccaaaatcatacataa

SEQ ID NO: 1032 - DNA, 349 bp, Artificial Sequence
  Affymetrix ID 3532235
atagtgttatatccgtgctgccatatcactaaaataggcttgccaaggcaggtgaggtgtatgaatgctcaagcctcacagaactgcaatcaagtgccaactataaataatactgaaaaaagttgaccatctgaccagtggataatactttcaaggcattcaattagcttatcctttgcagtattctaagctattcacattgacgatcacatacattgtagtgcttgctgcaagggaggcatataaccagttgttttggctaaaatatgacaggaaggcattccttgggttctatataaaagtaacagtattcaacagtctaatggcaatcactgataggctgcttaaa

SEQ ID NO: 1033 - DNA, 407 bp, Artificial Sequence
  Affymetrix ID 3053937
tgcacgctggaatcatggctcattgcagcctccaactcctaggctcaagggatccttccacctcagcctcccgagtagctgggagtacaggtgttcgtccccaccatgtctggctaatttaaaaaaatgtctttgcaggatgggatcttgctatgtttcccaggctggtctcaaactcctgggctcaagtgattttcccatcttggcctcccaaaatactgggattatacgtataagccaccacgtctggcctgagtcatctcttttgacccagaacaaaaccagtccaggagtggctgtactccccaggagtgtacactggggaggcccacagctccggggtgcagtggggctcttgcaatttaatgactgattcatcttcaaaaaagcacaatctcagccaggcg

SEQ ID NO: 1034 - DNA, 695 bp, Artificial Sequence
  Affymetrix ID 3304915
tgggagactgacctaactgagcatcaactatgccaagcactgcgcaaggtgtcgaggctataggaacgtgcctttctaccctagagaagtttgcagtctgctgtgggtgatgagctatatagaagaatgtactattagatggagggaagtgagggagcaacatggttacctgaggaagagcagtccaggccaagggcacagcaagtgcaaaggccctggggtgacggtgtgtgctggctgctcatgatgcagtagggaggcctgtggctgggatgaagaatagtggagggtaaagtggaaagaggtgagagcagagatgtagctggcagtggggagggaatagggtgaagcagcaccatgtagggccttgcaggacattctaaggattttgactttcatcgagtgagatgaagattcactgaggggttctaagtagaggcagggacatgatctggcttcaatcatagaatgatggggattgactaggcaggatgggttatgatgtgcaaggtcgcagggggctgctagccaggtgagataggatgtgggctctggcagcagtggagggggcaaggcactgcgggtgttggacagactctgatgattggatgtgggcctcaagggagagtttgtgtgggagctgggaaacaactgcatcaggttgcctggggtcccactcttaggccgacaacttg

SEQ ID NO: 1035 - DNA, 592 bp, Artificial Sequence
  Affymetrix ID 3545436
gcggtcactcagctatccaatgggatgacacacagcaaatcagctcttcactgcctcaacagacagtcactaaaataatttctttaaaggtatataaatgttggccagtgtaatcctctacaaaacacatttgcaaatataaaataatggaggtatgatgctgctcagagaatgggaatgctctggcagtccccaacatcctatcccacttggggctttgctccgaggggaagagcaggtgcaggatatattgccctttgatgtgatgtagatgctactagggacccactgggaagagtcccgttccttgagttatgctactgtagggatagacccttggtgtgaggaatctaacaatgagtcaaaggaaacatcacaaagaaggtgacacctcagaggagacaaaggactctgaaatcctggaatcacgggatatctctgattggttagggaattcctctgcactcaatctccagcaaatgggcagattccctcacaacttagaatttttcatggggagtgctggactgtaccccaaacatggagtaaggtggcatcatccatctctgaagggccatactcctcgcaaagc

SEQ ID NO: 1036 - DNA, 103 bp, Artificial Sequence
  Affymetrix ID 2632506
tgaatatgatagtctgagattgaggtggctaaggcagacgttggaatctttcatcccacagcctttgataaatgtaattaaagtgtctgaattggatggcaga

SEQ ID NO: 1037 - DNA, 54 bp, Artificial Sequence
  Affymetrix ID 3333132
cctgagttcctgggcactctttcctgagcttgcttggggctgatttgaattcag

SEQ ID NO: 1038 - DNA, 27 bp, Artificial Sequence
  Affymetrix ID 3459329
ctctggattttgccactcacacagttg

SEQ ID NO: 1039 - DNA, 67 bp, Artificial Sequence
  Affymetrix ID 3597530
gccagtgaaggtttgaagagtataaacccaggtgagacagcaccctctatgcgactgctggcctatg

SEQ ID NO: 1040 - DNA, 57 bp, Artificial Sequence
  Affymetrix ID 2757682
aacagtgcaagaaaggacgcatcactctcttctggtgccgatgtgctctcttgttaa

SEQ ID NO: 1041 - DNA, 239 bp, Artificial Sequence
  Affymetrix ID 2811303
tcacgtggctttgtgtaccaggcgtccagggagcaattaggagggcaatctgttaagtcttttgcctcagggcagaaccattaggtgtgctgtgtatgtgcctcaaggggtgtaaataactaagctattcatgtactcatcagtttcctttcaaggcatctgtgaaacctttaatctgtggaagaatcagagaaagttgacctattgtattattatcctccctcacctgaatattttga

SEQ ID NO: 1042 - DNA, 1335 bp, Artificial Sequence
  Affymetrix ID 3611032
gagtccttttgtcctgcggtccatataagagggtctggatctggagacactgtagaacaccaagcagctatcatgaggctatggaagtgtcgctgagagcaggaaactaaggtctcccttgaatgagagaaagatgacctcattcttaggccctgctgtgatggaattagcatgctcctgggatgtctcctagtgactgacctttggtttggatgttctgagggatctaggcaaaagtgaacagttttagcactatttcacaaaactctctgtgactatctgtatgcaaaaaatagatttaaaagtagtatttttaaaaataaaggcaagaaccttggtactgaccagaggatgggctccagtttctatttttaaatgtggcccttgttatagcctggaaaagatttaaaaaaatagttttgttttttttgtaaacacatactctacttttattaatatataggctgtctatactcttgactacacagcaatgtcttagttattaggaaccaaatattcagcttatggactacccagggctggctttggcttgatttctcccttctgcttactttaagtcttgccatttgattgcttgtagtaggctagggcaaatcaaggagaggagaaagattaaagttgtgcccaaaatggccaaaataattttgagaaagaatgaggtggagaggtggaggaacttgctttactgaatgccaaagacccttttatttttttaaataaagtaattaagacagcatgtttgtcacccggggtagacaaaaagaccagtggaacagggcagagagcccaagccttgacagatgacagaaatggccttgcgggattggtgaggaagaggtgggctagtcaataaatgggtactgggaccgctggttttccaaatggaagaaaatggatcactaccccaaatcaaacacaaatattaagctcaagaaagatttgaaggactaagtgtgaaatgcaaaacttggagcttttagatgaaaatactggaaaatatatatatatatattttttgatggagtctcactctgtcgcccagactggagtgcaagtggggtgattttggctcactgcaacctccacctcctgggttcatgtgattttcctgcctcagcctcccgagtagctgagattacaggtgcccgccaccacactcagctaatttttgcatttttagtagagatgaggtttcaccatgttggccaggctggtctcaaactcctgactgcaggtgatccacctgccttggcctcccaaagtgcggggattataggagtgagccaccatgcctgaccggaaaatacgatcttg

SEQ ID NO: 1043 - DNA, 25 bp, Artificial Sequence
  Affymetrix ID 3977071
gtggctggaccatgcggaactggat

SEQ ID NO: 1044 - DNA, 43 bp, Artificial Sequence
  Affymetrix ID 3363301
tgatggaggacacgcagcacaaattgcgcagcgcggtggaaga

SEQ ID NO: 1045 - DNA, 30 bp, Artificial Sequence
  Affymetrix ID 3644748
tgggccacgtggtgctctctgaagttagaa

SEQ ID NO: 1046 - DNA, 33 bp, Artificial Sequence
  Affymetrix ID 3799937
catgcagtccccaaggctatcggtcctcctcag

SEQ ID NO: 1047 - DNA, 64 bp, Artificial Sequence
  Affymetrix ID 3336773
gaggagcttgccaacagcgatcccaagttagccctcactggagttcctatagtacagtggccaa

SEQ ID NO: 1048 - DNA, 40 bp, Artificial Sequence
  Affymetrix ID 2822962
tgtgagaacagactcggcagtgacatccactccaaatgga

SEQ ID NO: 1049 - DNA, 30 bp, Artificial Sequence
  Affymetrix ID 3627325
ccagacctgagccacgtagctatcaaacac

SEQ ID NO: 1050 - DNA, 82 bp, Artificial Sequence
  Affymetrix ID 3780263
catctgaaattaatgggactaatgtaaggattgatattttcatatttgctcaattgcatcctgggttaagcacattcaacag

SEQ ID NO: 1051 - DNA, 26 bp, Artificial Sequence
  Affymetrix ID 2656010
atggcgctatctctgccctcagtatc

SEQ ID NO: 1052 - DNA, 84 bp, Artificial Sequence
  Affymetrix ID 3028587
tcacccaggattctcctgtacctgctcccaatctgtgttcctaaaagtgattctcactctgcttctcatctcctacttacatga

SEQ ID NO: 1053 - DNA, 26 bp, Artificial Sequence
  Affymetrix ID 2419066
gttgcctttgagtgatggtccagaag

SEQ ID NO: 1054 - DNA, 25 bp, Artificial Sequence
  Affymetrix ID 3081481
atggccacctgtgttgacgtggaga

SEQ ID NO: 1055 - DNA, 26 bp, Artificial Sequence
  Affymetrix ID 3935290
atgatgaaagcgtggaggtaccagct

SEQ ID NO: 1056 - DNA, 729 bp, Artificial Sequence
  Affymetrix ID 3051677
ttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctg

SEQ ID NO: 1057 - DNA, 30 bp, Artificial Sequence
  Affymetrix ID 2699603
aaagaaggatctgtcagccaagtcttttct

SEQ ID NO: 1058 - DNA, 421 bp, Artificial Sequence
  Affymetrix ID 2836754
agtgtggccgtttgcattactgctggaattttgaagactactacatattccgtcagtgtcaggattttgttcttcagtgtggtacttttttttttttttttttaagatggagtctcactctgtcgcctgggttggagtgcagtggtgtgatcttggctcactgcaacctccagctcccgggttcaagcgattctcctgcctcagcctcctgagtagctgggattacaggcatgcgccaccacacctggcttatttttgtatttttagtagagacggggtttcactatgttggtcaggctgttcttgaactcctgacctcgtgatccgcccacctcagcctcccaaagtgttgggattacaggcgtgagccaccgcacccggtagtgtggtacactcttaaaatcatagttcctgctgtctg

SEQ ID NO: 1059 - DNA, 33 bp, Artificial Sequence
  Affymetrix ID 3504560
gcatggccatggatcgggcaagttggttttact

SEQ ID NO: 1060 - DNA, 81 bp, Artificial Sequence
  Affymetrix ID 3924596
agacctgaaggcacaatcacaagaagagatcaggcgcttgtggtcccagcttgattctgccaggaccagtagacaggaatt

SEQ ID NO: 1061 - DNA, 30 bp, Artificial Sequence
  Affymetrix ID 2408919
taggtgacggattgttaggtgcagtaaacc

SEQ ID NO: 1062 - DNA, 520 bp, Artificial Sequence
  Affymetrix ID 3219942
ggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctag

SEQ ID NO: 1063 - DNA, 27 bp, Artificial Sequence
  Affymetrix ID 3240958
gtcaacaagaccttgctggacctcgtg

SEQ ID NO: 1064 - DNA, 146 bp, Artificial Sequence
  Affymetrix ID 2830809
gtgcagattgttaatccctagtgtgcagggatagggagggagaggaaatgtccacacagacgaggagaaggcctgtaaatgcaaatttcacactgttgatggtttgtcctgttggttgaccagcattcccaagataaccaggtgag

SEQ ID NO: 1065 - DNA, 362 bp, Artificial Sequence
  Affymetrix ID 3020549
cctcatgcatgcttcgagatcattgtttgcttcatttccctaaaatctacagttcctttgaaagtagactctggcgttatcacctttccccggtctttttgcagtttcctgttgacctctgagccattctccctcactcttgtttcactctgtttgcaacactacctcttcctgtatcctggcctctcatttctcacagatcatcatgctgttcttgaaacattttatttacttgattttagaaaactatactcttagtttccctaaaatctcataatctctttgcgggattttcctcatctttgtgacttccaaaatttgaagtgtcccctggccagtcctgggtggctacattcaatctc

SEQ ID NO: 1066 - DNA, 87 bp, Artificial Sequence
  Affymetrix ID 3282482
aaaagaagtcgtttattggtgcatgggacactctgggaggtagtatccatttggatgtcctgctgcggttggagacatggaacaaaa

SEQ ID NO: 1067 - DNA, 81 bp, Artificial Sequence
  Affymetrix ID 3192070
cctgtcggtggactgaatgggccaagtgttcagaagtccttgggaagaggatagtgtcctgaatcataatgtggtattttc

SEQ ID NO: 1068 - DNA, 546 bp, Artificial Sequence
  Affymetrix ID 2473609
aaagtgtcctattctcggggtggcagggaggggggcaggccacaaaggacatgagtgttaggaaaagaagaaagcacagggaattaaggcaggaagggataggctaactactgttctgtgcaaatgcaattgggtttatgatcaggactgactgcccttacgtataaagttgctaacccccaagacctgaagggaaaagtcttttgaagctgccagttttttgatcattcaacaagaagacctgaacactgagaatcctttttctggattggttccatcaatactttgtccctgaaatcaggaaataccttgccattatgggacagccctttaaagttcttttgatgttggacagtgcccctggccacccagaaccccatgagtttaacaccgaaaacattgaagtggtctacttgcccccgaacacagtctctaattcagcatctagatcaggggatcatgaggacctttaaggttaataacacacggtactctaacctcaatagaacatcatgaaaatctggaggaattacaccgctgaagatg

SEQ ID NO: 1069 - DNA, 79 bp, Artificial Sequence
  Affymetrix ID 2814779
actctgctgactgtaatggctctcacgcagttcctaatgggcactgtggaaccactcagcatagacaggcataggcagg

SEQ ID NO: 1070 - DNA, 28 bp, Artificial Sequence
  Affymetrix ID 3558342
gcccagtgaaggggtgacagaactagcc

SEQ ID NO: 1071 - DNA, 162 bp, Artificial Sequence
  Affymetrix ID 3611698
atctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttcc

SEQ ID NO: 1072 - DNA, 600 bp, Artificial Sequence
  Affymetrix ID 3701429
tgccgcttttccctccacttgtgtaacagcatactcaggtttataccaactgggagacacgcaggcatctcccctcacaagcagctgtctactcaattctgtagttatgtctgctaagtaatcagaatgcacaataggtttttagcatctgtatctcatcctcagagtagagagtacctgttttacgagagaaaactgagaaaacggtctctcagggcctctggggcagccttcaattggacagcagtagaatttcggtccagttttcaaatcttttcttattgttggattgactatgccatcctgcaaaaggaaaattactttaaattattatttcaaaaaaacaacacaacaggctggagtggaaacggaatgactgaaaacgagcacattttgtgaaatacttttaattaagagtttttccatctagtgtcagcagtaagagaaaaagagtatgagtagattaaacgaaatgtggtgagaatactaagcaagactctaaaattctgcattcatttgaccattactgaattcctcttagtcaatttacattccagggagatgccccccttgtatgttcctaggctgtgaaatgctcca

SEQ ID NO: 1073 - DNA, 100 bp, Artificial Sequence
  Affymetrix ID 3933333
ttccgccggcggcatcaacagaaagacccaggcatgagtcagtcacacaatgaccttgtgttcctggagcagccagagggttcccggaggaaaggcatca

SEQ ID NO: 1074 - DNA, 29 bp, Artificial Sequence
  Affymetrix ID 3799749
ttggattccactaatcacccgatcacccc

SEQ ID NO: 1075 - DNA, 68 bp, Artificial Sequence
  Affymetrix ID 2487131
gaaagctgcactccaggtcagcatgaacgatggcctctcttttatctccagttctgtcatcatcacca

SEQ ID NO: 1076 - DNA, 513 bp, Artificial Sequence
  Affymetrix ID 3187719
gggcaaacttcagcctcattagatagaggctggacttccggaagagctgggaagggggaccatagtttctggggaggggtggagaactcacatttacctagctgctggccaggctattttcatacccacagaccgatttaattctcaactactgtactcatttagtagatgagaagaatgagacattgaaaacatgcacagtggaggtgggaatgaaagccagctctccaactctccagtcctctttcctgtcactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacc

SEQ ID NO: 1077 - DNA, 133 bp, Artificial Sequence
  Affymetrix ID 3474744
ttagtgtacccttcggtgacaggtaagggctttctgaaacgcattgtctttttattatagccattctagtagtaaggtgtgaagtggtatctcatagtggtttgggttgtatttccctgatattgggatgttg

SEQ ID NO: 1078 - DNA, 35 bp, Artificial Sequence
  Affymetrix ID 2489696
atgcagttacaaaatcggattcagcatcagaacag

SEQ ID NO: 1079 - DNA, 25 bp, Artificial Sequence
  Affymetrix ID 3195395
gtgagtcgacagccagggcttggca

SEQ ID NO: 1080 - DNA, 29 bp, Artificial Sequence
  Affymetrix ID 3497381
ggtggacagtgatggtttcaaaggggaaa

SEQ ID NO: 1081 - DNA, 91 bp, Artificial Sequence
  Affymetrix ID 3130174
tcattgttggtgcaggttacattgctgtggagatggcagggatcctgtcagccctgggttctaagacatcactgatgatacggcatgataa

SEQ ID NO: 1082 - DNA, 147 bp, Artificial Sequence
  Affymetrix ID 3180421
gagaggtggatctgtctggacttcaggctgtgagaacctcacagcacagataggatgtgagctttaccccttgtgttcaggccgctcgcacggagtcagcttgcggaagcacgttcccaggcctgctctgcgtgtaatggtggaatt

SEQ ID NO: 1083 - DNA, 89 bp, Artificial Sequence
  Affymetrix ID 2384882
gaagtcggtgaagcacatggatttgtgccttactgtggtggaccgggcaccgggctctcttataaagctgcagggctgccgagaaaatg

SEQ ID NO: 1084 - DNA, 216 bp, Artificial Sequence
  Affymetrix ID 2601621
tctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttt

SEQ ID NO: 1085 - DNA, 31 bp, Artificial Sequence
  Affymetrix ID 2624206
tggatggcccggattttatggcatctggaac

SEQ ID NO: 1086 - DNA, 69 bp, Artificial Sequence
  Affymetrix ID 2626149
tcaagattgtggagttggactgaatgctgcacagttcaaacagctgcttatttcggctgtgaaggacct

SEQ ID NO: 1087 - DNA, 351 bp, Artificial Sequence
  Affymetrix ID 3466862
tgtcacttagtctactgccagtctactgtctgtgccaccatgggaaattgcatgagttcagacctgtgaaaaatcagaataaagataaaaacacattttttgaaggttacggaaattcttaagatcttggttttcttgaacttactactagtactactgatttagaaatggcctacctcctatagtaggaaagggcaaagaaaacaatagttaatagggaaggcttaaaggagcttgagggctgtcctggcaataatagaagagatccttgttttttaaaggagagttaatgtacaaagattctgaaaagtctagaaacatgggtaaaatttttatgattgccgggcgcgg

SEQ ID NO: 1088 - DNA, 236 bp, Artificial Sequence
  Affymetrix ID 3400762
tcaatgaccagcgtagacagagctagtagcagcaatgagatgagtgactagagaggtagagagaaaaccaggaaagtgtggagtcatggaagctaaggaagatggtgttgggaatagaggtggtgaacagagtcccctgttcttgctgataggagaggtcaaatgagataaggacagaggcgtggcctttggattccgagatgtgttgatcaccggtgcacttggcaagcatgcca

SEQ ID NO: 1089 - DNA, 164 bp, Artificial Sequence
  Affymetrix ID 3511392
aatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagca

SEQ ID NO: 1090 - DNA, 264 bp, Artificial Sequence
  Affymetrix ID 3762555
tgcacatgtggtaagagcatccagcaggaaagaagagggcaagttgagtgtgcgtgggcatgaaggattcactgtacgcatcccagccctgctcatctcagccgcatggactgggcacacatttaagcatggagggtggtggttttcaggctgttttctagagctgtagaactcaaatgaaatgctctgagtctgtgagggggggaggagtcaataaagggtggctaagtgcatggagtttgaggtacccgctctgctgtaacc

SEQ ID NO: 1091 - DNA, 43 bp, Artificial Sequence
  Affymetrix ID 3853067
gcttgctgctctcacgggagaacgaggatcaggtggtcaaggt

SEQ ID NO: 1092 - DNA, 179 bp, Artificial Sequence
  Affymetrix ID 4015570
ttcatggttgcctagtgctgcgaggagtggggaatggggaatgagtgcttaatgggtatgggtttcttggggtgatgaaatgttccggcactaagttgtggtaatgactgcatgactttgtactaaaactactaaattgtacactttaaatgggtgaattgtatggcatatgagttatt

SEQ ID NO: 1093 - DNA, 34 bp, Artificial Sequence
  Affymetrix ID 2458440
tgcacttttgcctccgaactctcgtgtttaatta

SEQ ID NO: 1094 - DNA, 35 bp, Artificial Sequence
  Affymetrix ID 3333734
atgggttccaggttcgggacatagagaatctgaag

SEQ ID NO: 1095 - DNA, 50 bp, Artificial Sequence
  Affymetrix ID 3379257
ggccgtgcagcttcttgacaaattgcaaaggtgcccacgagtttccaagt

SEQ ID NO: 1096 - DNA, 50 bp, Artificial Sequence
  Affymetrix ID 3662461
ctcaacttgatcacgaggttcctgacaccgtccgagctcctttttgatct

SEQ ID NO: 1097 - DNA, 27 bp, Artificial Sequence
  Affymetrix ID 3670791
gtgcaggtctaatgggctccttccttc

SEQ ID NO: 1098 - DNA, 32 bp, Artificial Sequence
  Affymetrix ID 2689662
ctcatggcaacttcttccgcttcctagtttca

SEQ ID NO: 1099 - DNA, 38 bp, Artificial Sequence
  Affymetrix ID 2698749
gctgggatcactatggaagcaactatgcattgggggca

SEQ ID NO: 1100 - DNA, 91 bp, Artificial Sequence
  Affymetrix ID 3940626
tgcaggctttacctatgaccgaacatgcatggaaatgccctctgatggactcaggcatgatacatacatcaaacagccttgcacggtggta

SEQ ID NO: 1101 - DNA, 58 bp, Artificial Sequence
  Affymetrix ID 2577438
gagagcatggctacaacagcaatatttctggaaaccagttatcgggggaattcacagg

SEQ ID NO: 1102 - DNA, 49 bp, Artificial Sequence
  Affymetrix ID 2885881
atggactcatcccagaacaatcctcaggcactccgaaatgcagatgccc

SEQ ID NO: 1103 - DNA, 77 bp, Artificial Sequence
  Affymetrix ID 3473848
atggctccagaggtgatcttagctatggatgaaggacagtatgatgggaaagttgatatttggtcacttggcatcac

SEQ ID NO: 1104 - DNA, 687 bp, Artificial Sequence
  Affymetrix ID 3721713
agaacctggtcgtgtcttgagaacccagtccaaacagaatcaggcctctggactgggagcaacactcccttcacccgcaaagattcaggaaaagcaccccaaggacaaggaaaccaatgaggtctgggctagctctgcagctttaggatactagctctagggaaggattttttcctttttaaacagcgtatcactctgttgcctaggatggagcacagaggcaccctcatagctcactgcagcctcaaactcctgggctctggcgatcctcccgcctcagcctcccaagtagctgagaccacaggcacgtgccaccatgctcctagggaaggagcttgagaagaaactgccaggagtgaaccagggctggctgctctgtgatgttctctccccacctcccctccagctctcaacttggtggcagggccggcaccctgctctccctcctaactcccagcctgctgctgcccccttctgggaccctaattttctggactttgagaaatgggctgcccctgggggtgcctccaagagcccatttgagggatcgggtggggctgacctctctgtcttctttggatcatcgccttctcacactgtcctccctcttgattctgaaaaatggtcctgctgcccatggagaaccacagtaagatagatttctcatgcagctagtgaggggacttc

SEQ ID NO: 1105 - DNA, 25 bp, Artificial Sequence
  Affymetrix ID 2924660
accatgtttttgcctccagtctgtc

SEQ ID NO: 1106 - DNA, 55 bp, Artificial Sequence
  Affymetrix ID 3242466
atggctatgggaatatcgggagttgaggaagaaaaaggctccagtggcactgaag

SEQ ID NO: 1107 - DNA, 110 bp, Artificial Sequence
  Affymetrix ID 3268238
agcagctcaccaccggctgcgagaagtggctggaaatgaacttggttcctctaggggggacgcagatccacctccacaaaatcccacaggacctgctccacaaagtgctg

SEQ ID NO: 1108 - DNA, 159 bp, Artificial Sequence
  Affymetrix ID 3293847
tgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatcca

SEQ ID NO: 1109 - DNA, 454 bp, Artificial Sequence
  Affymetrix ID 2416565
aatcttgctttttgtggcctggggattggctgtgtgatcagcattgaaatgggttgttgcagtttgaagtctggaaggggtatgtccctgggttctaattctttccctctaggtttctgtactcagctcagagtctagaatggtagcttttaggattggaaaagaccaaagttacctaattcaactctttcatttttttttcagtggaaaaactaatacccagaaaagggaagagagttaacccaaaaattacatctagtgaattgtctgattagctttacaattgaggcattgtagagctctttgaggcattagtcttggttgtctgagtgcctggctattaaaggctgtctttgcctgttccctctttctgttagctgcctggaagtgcagggttgcttcacttttagcaccttgactctgtacctgacatggtgcttcaacaggatattgc

SEQ ID NO: 1110 - DNA, 98 bp, Artificial Sequence
  Affymetrix ID 3198506
gtctacgcagctgccatagaggagggggattgtttgggagaccttcccgtggcagaatcaaagctcgtagttcagctgcgggaatctggtgtacttaa

SEQ ID NO: 1111 - DNA, 33 bp, Artificial Sequence
  Affymetrix ID 3384336
gggaagacgtgcctcgtccgaagattcactcag

SEQ ID NO: 1112 - DNA, 25 bp, Artificial Sequence
  Affymetrix ID 3649726
ttgtgcaacagaaaactcaacccaa

SEQ ID NO: 1113 - DNA, 176 bp, Artificial Sequence
  Affymetrix ID 2732288
aggtttagttgtgtggccgtaatcacatccaacaccaagtcggccaaccatatgtgagcttaatcccacagaattcttatgttagacctccctcttcagataatagaggagattttttttaagtatacgtgcacagaggaagtgacttctttctgcgcactctgttgtcactggaa

SEQ ID NO: 1114 - DNA, 209 bp, Artificial Sequence
  Affymetrix ID 3291868
tacgaggaagtgaccagtgttcatctgaaacggatgccttgtttctcagaaatgtcattctctttatttcatcttcgtagttctgtgccttctctcagcaatttctgatttctttatttactgccacacagatgacaaatgacatgcatgtccatgataccctttactcaattcacatgcgatttccaaggctggctataattcccaaa

SEQ ID NO: 1115 - DNA, 103 bp, Artificial Sequence
  Affymetrix ID 3572359
gtggggggctgtaatctacaaaagccatcttcagtaccaggtttaattccatcattgtttttcgggttttaggtctctggactattgtcctttaacaacaaca

SEQ ID NO: 1116 - DNA, 80 bp, Artificial Sequence
  Affymetrix ID 3613987
gcctgcctgttcatgccaaatatacatcctcacaatgcacagtacacaacatgggcacataggcacagaggctatgccgg

SEQ ID NO: 1117 - DNA, 373 bp, Artificial Sequence
  Affymetrix ID 3768275
ggctttgaagggcaactgaccaacttttttatacataaaggatataaactacaactattttcccactctgtgtagaatgtggaacggaaacagtgtgtggcacactttaaatgatgctaaacttctacagtgtgtaaactggcttgttcaagaggccaaagtgcttctgttgagaaacactgatgaccaatctcctctttgtggtcctgtgatactgtgaaatatatatttgatcttcctccctgtttcccagcatacaattcctaaaaccctcagaatctgcaaaataagatttttttttaatgctaatgattgactgatggctggaggctcctagagagcctcaggattggggctgattctcagggctttc

SEQ ID NO: 1118 - DNA, 128 bp, Artificial Sequence
  Affymetrix ID 2367980
gaccatcttctccaggtggactacctgaagaagatagtgttttatttaataaactgacctacttaggatgtatgaaggtttcttccccacgtaatgaagtagaggctttacgggcaatggcaaccatg

SEQ ID NO: 1119 - DNA, 25 bp, Artificial Sequence
  Affymetrix ID 3063344
gtgtgaagaatgcgagaagagcttc

SEQ ID NO: 1120 - DNA, 45 bp, Artificial Sequence
  Affymetrix ID 3147137
tttaggaaaaggctgctatactgtggacgaagtctcagatcagaa

SEQ ID NO: 1121 - DNA, 134 bp, Artificial Sequence
  Affymetrix ID 3737089
acgggacgctttctctgggatgcattgagtcagggaatagaagatggggtgaatgatgtttctgacccacagaccgttgggatgcttttgctgtcactttcccatcatgctgcatgaggcatgacagcagctgt

SEQ ID NO: 1122 - DNA, 222 bp, Artificial Sequence
  Affymetrix ID 2686311
tgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcact

SEQ ID NO: 1123 - DNA, 277 bp, Artificial Sequence
  Affymetrix ID 3307401
gccactctgctcaaagttggcacgagttggaatgtaatcaccatctctgcactcaaggcatgcagaaatgaagtctacctcagccctcaaagacctcacctgagaaaaagacaaggctccaaacagaaggcaaaacagaatgagcatagaaagagaccactttttcacatacctttacaaagcactgctcacccctccttaacctcgcacagacagagcatggggcctcagtgtcactgccactgccaccctcccactgactagctgtactctctga

SEQ ID NO: 1124 - DNA, 1047 bp, Artificial Sequence
  Affymetrix ID 3648042
ctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatcta

SEQ ID NO: 1125 - DNA, 26 bp, Artificial Sequence
  Affymetrix ID 2568862
tcttcttctagcagtgctcagtgggt

SEQ ID NO: 1126 - DNA, 230 bp, Artificial Sequence
  Affymetrix ID 3405549
tggcgtgagcgagataaacctcctaacagtaggtttgtacaataaggccatagggcaccgatgcctgtttccataattgttgtaattttatgggctttgaagtgttgctctagatacttactttctcctttcagggtagcgagaggctcccattagaatatttcatatgtacctgtctggtttgcaagctgttgagttgatttattcagccctagtggtaataatgactc

SEQ ID NO: 1127 - DNA, 29 bp, Artificial Sequence
  Affymetrix ID 3479324
aactgaaggagcggatcagagagtattta

SEQ ID NO: 1128 - DNA, 967 bp, Artificial Sequence
  Affymetrix ID 3736140
tggatgtctactttgcacgctgcgattgggagagctgtcccgctgcatgcgttccctctgtaatttcctcagagctcacatacgtacctctctcacgagtgaactcagattttccattgttttgctttattctatcatttgctttgtggttttgctgtaaatattgaaatcttaatcatcatcgagaggcacagccaagctttccagctctccacccccgtggcccatccaagtctgttcatctggtaacttctgttgtctgggacggcagcaagaagatgccggggcttgcctggagtcctggcagaggagtgccactcacttttgcctagggtccagttggggcttaaaaaatatttggagagaagagtaatgaggattttttgtgtttcctagacattttatgcatctatttttgtaaaatcaccttcgctaactttcaccaagcactttgagcacagtggaacttcagaagcacaaccagcctaaccccagaatctcaggtggcacagctagaaattgagtcccttcctaggacactggccgtggccttcagggtgaccagtcagtgccaccgggttggcattggtgttacagacaggcctctgaagacaaaccgagcaccccagcggcccctcaaactaagcaaggatcttttttctgtctgcgctccctggggcaaggtcaaaggtggacccgcccactgtgggtcaattccttcgaaaagatgggacccgcacccccgccacaggctggcccccccccacccatggggaaggtggtgtgctgctggctctgaccatactcttttggaaattgagaaggaaagcattgagtgggacctaatccggagaagaaattaaagaccagaaaaagaaggaagctgggaatgaaactcaaaatgcacttgaacctggaagcggcaaccctcagctctgcgcggccgagcctcagcaagagttcgttt

SEQ ID NO: 1129 - DNA, 305 bp, Artificial Sequence
  Affymetrix ID 3954953
catggtctaaccacagaggggaatactactcagcaatacaaaggagtctctcctaatacgtgcaacaacattcatgaatcccaaaaactttatctggagccaagccagacacaaatgtgtacatacagtacggaatgacttcagattctgaaaaaaggcaaatctgaccaattgaggcagaaagcaggtcagtggttccccaggtctgggactggggtgggttactgatagcaaatgggcatgtgggtgccttggggtagggtaaaggttccatcttgatcacggtggtgtttcccaagtgtata

SEQ ID NO: 1130 - DNA, 239 bp, Artificial Sequence
  Affymetrix ID 2396759
tcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctca

SEQ ID NO: 1131 - DNA, 65 bp, Artificial Sequence
  Affymetrix ID 2519281
ggtgagcgggaccatctcatcactaagcgggatcttgccctcagtgaaggagatattcacacttt

SEQ ID NO: 1132 - DNA, 71 bp, Artificial Sequence
  Affymetrix ID 3640619
tctgttgtctcgcccttgctctgctcctacttcacccatcttctgagatccaagtcaaaatcatctgcacg

SEQ ID NO: 1133 - DNA, 26 bp, Artificial Sequence
  Affymetrix ID 3976861
acctaatcgtgggactgcaagggatg

SEQ ID NO: 1134 - DNA, 274 bp, Artificial Sequence
  Affymetrix ID 4048293
ggggtagaacaatcaagcttattcctaaggattttcttttgacaaataaatgggtggtagtgttgtttattgagataggaaaaactatgggaggaaatgatttgaagtgggtggtttgaaataaaagttttgtttaaatatgagatgattgattgacatttatgtggagaaatccgaaggtcaatggcatttaagagactcatggtgaggccagggcttcaggtatttatgttggcagcagcaatacgtgtagtgtgttaaattccagggcgtg

SEQ ID NO: 1135 - DNA, 208 bp, Artificial Sequence
  Affymetrix ID 2393657
ccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttaca

SEQ ID NO: 1136 - DNA, 25 bp, Artificial Sequence
  Affymetrix ID 3389355
aggtttttggaattatgtctgctga

SEQ ID NO: 1137 - DNA, 142 bp, Artificial Sequence
  Affymetrix ID 3584178
attgtagtttgaagagctgcccttgggaactcatgggacaggcatcaggcctggaatgggatggacaagtggggcctccaggagaaggagcattgcaggagatgctggagagtggggagcagtacgtgcagcagatagggga

SEQ ID NO: 1138 - DNA, 60 bp, Artificial Sequence
  Affymetrix ID 2365984
tcaccagttaagcaggctcctcggaagtccccctccgacactgagggtcttgtaaagagt

SEQ ID NO: 1139 - DNA, 243 bp, Artificial Sequence
  Affymetrix ID 2468456
aaagcaatcttaacagtgagggctatgaaaccgttgaaaattctcccaagggaagtgatggaaacctccttgcttgagtcatttcaaagtcgacaaaacaacgaaaaatacatggagggagggatcctgtagtgttggggagcagactcgatgatttcatagttcttttctgtctctgatttccatgttctgtgaaatagtattgcagctaagaaacatgaaatccttcactccgacagtatg

SEQ ID NO: 1140 - DNA, 81 bp, Artificial Sequence
  Affymetrix ID 2954656
acctgcttcggctactggctgggagtctcatccttcatttacttccttgcctacctgtgcaacgcccagatcaccatgctg

SEQ ID NO: 1141 - DNA, 26 bp, Artificial Sequence
  Affymetrix ID 3499189
agatggcatattgtgctcggggaagg

SEQ ID NO: 1142 - DNA, 99 bp, Artificial Sequence
  Affymetrix ID 3102170
gaaggatattattacagagacaatgtttctgtggaagaatttcaagctcagataaatgcagcctcactggaaaaggtcaaacagtacaaccagaagctc

SEQ ID NO: 1143 - DNA, 63 bp, Artificial Sequence
  Affymetrix ID 3151372
caggcactgtatcaggtgctgcgtacttctgctagctcatctcacctggtcatgccgctctga

SEQ ID NO: 1144 - DNA, 31 bp, Artificial Sequence
  Affymetrix ID 3153640
ttcttccttgatgcaggatctgaggttgaag

SEQ ID NO: 1145 - DNA, 63 bp, Artificial Sequence
  Affymetrix ID 3708351
tcacattctggggttagaaggggcccaatggatgggaattcttcatataaaagaggaaatgcc

SEQ ID NO: 1146 - DNA, 54 bp, Artificial Sequence
  Affymetrix ID 3793991
tgcaacaatgggagctttttaactagtctctgtaaggcgttgtcatcacatctg

SEQ ID NO: 1147 - DNA, 76 bp, Artificial Sequence
  Affymetrix ID 2840186
catgagttcatgagtgacaccaacctctcggagcatgcggccatccccctcaaggcgtctgtcctctctcaaatga

SEQ ID NO: 1148 - DNA, 503 bp, Artificial Sequence
  Affymetrix ID 2945913
ttgcctcccggagtgtgtaaccacatgagaaatagagggaaggttctgtccttaagaagttaaaagtgtgactgggaaggtaaaacatacttattaagggttaactagcatcatgccattctgtgtgatggtgagtttgtgtgtgtgtgcacatgtgcgtgagtacacacatatacatttaaaaaggtcttgaatataccaaaatattatgtctaggtgatgggtagcttgtatattttttctgtatccttgtctgtgtttgtcaaattttatagaaacaataacagtaacagctctctgaccttctaccctgtatgttctgcgtcctgtctaattcctcaagttccttcactgcctgtcactctgatgcttgctatatatcagcccatcctgctttttgtttcttagacccaaagtgtcaagtgcacacctgccctgggtctttgtgtttgctgtttccatttcctggagtgcagctggccctgatttgcatgtgaccagca

SEQ ID NO: 1149 - DNA, 26 bp, Artificial Sequence
  Affymetrix ID 3706405
tcgtcactggcagcgtagatcaaaca

SEQ ID NO: 1150 - DNA, 26 bp, Artificial Sequence
  Affymetrix ID 3898481
atggcggcagagtatctggttctctt

SEQ ID NO: 1151 - DNA, 113 bp, Artificial Sequence
  Affymetrix ID 3962245
tgctcttgctgggacatgtggcccaggtgctgatgctggacaatgggctcctgcagacaccacccatgggctggctggcctgggaacgcttccgctgcaacattaactgtgat

SEQ ID NO: 1152 - DNA, 36 bp, Artificial Sequence
  Affymetrix ID 2877309
cacagagccatggtccatccgagagaagctatgttt

SEQ ID NO: 1153 - DNA, 43 bp, Artificial Sequence
  Affymetrix ID 2973720
gtttggtgtctggtacttagagctccctgaaactgtggtgttt

SEQ ID NO: 1154 - DNA, 86 bp, Artificial Sequence
  Affymetrix ID 3091762
aatcatttgcctctcggccacattgtttacttttttaacttttttgattgatgtcacaagattccgttatcctgaaaggcctatta

SEQ ID NO: 1155 - DNA, 138 bp, Artificial Sequence
  Affymetrix ID 3418179
ctgagctcatccagtaaaactctcaaaagatgaatagatgcccttttccttgaggagccttctgcctgatttctttgtcactgagtttgggtccctggttggagtggcaggaggaaggggtccaccacgtcttctgac

SEQ ID NO: 1156 - DNA, 33 bp, Artificial Sequence
  Affymetrix ID 2685385
tttggtgtctttctgaagggattcggcccggag

SEQ ID NO: 1157 - DNA, 231 bp, Artificial Sequence
  Affymetrix ID 2912792
ggatgaaatcgtgcacgtccctcttcgtccctctcaggacagaaattcttttgtccagcatatatctatgttgcatataccaccagccaattagtcacttagtagctggtgttggttatgagatcaactgtcatagtatcacagtgcttgtttcaggtaacccttatgttatttaatagtggcccaagagtgcaagagtactgttgctgacaatttggattcacgagaagc

SEQ ID NO: 1158 - DNA, 28 bp, Artificial Sequence
  Affymetrix ID 3590727
tctggtatgacatggaatacgacctcaa

SEQ ID NO: 1159 - DNA, 37 bp, Artificial Sequence
  Affymetrix ID 2363028
gaaacgccgtcctgcggaaacatccaccatccggacc

SEQ ID NO: 1160 - DNA, 211 bp, Artificial Sequence
  Affymetrix ID 2374733
tagagactggatcatagaaggagttgtttgccatgcttacccttaaaggctttctgagcagtcatcctgggatggacagggcagggagtggagagaccagcgagcaggtttttgttacggttcgagtgagggttgaacacaggcagtggtggtggagatgggttgcagggataatcttgagagagatttaggagacaagattcacaggttg

SEQ ID NO: 1161 - DNA, 27 bp, Artificial Sequence
  Affymetrix ID 2448301
gagattcagcgattgcaggaggacact

SEQ ID NO: 1162 - DNA, 38 bp, Artificial Sequence
  Affymetrix ID 2596900
gaatggtgggaaatgtatgcttgactcaaaacagccag

SEQ ID NO: 1163 - DNA, 28 bp, Artificial Sequence
  Affymetrix ID 2713805
ctatatgttctcctttcagccaagacct

SEQ ID NO: 1164 - DNA, 57 bp, Artificial Sequence
  Affymetrix ID 3878694
ggggtgtctgcgtggggagaaatcagttgtcggcattttaaatctctggataatgag

SEQ ID NO: 1165 - DNA, 1459 bp, Artificial Sequence
  Affymetrix ID 2434634
cggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggca

SEQ ID NO: 1166 - DNA, 26 bp, Artificial Sequence
  Affymetrix ID 2502158
tgcactttcccagcgtttctgtctgc

SEQ ID NO: 1167 - DNA, 106 bp, Artificial Sequence
  Affymetrix ID 2511348
agacaacagtaaagaaataccagcaatttgaagccctgtccctgaatcctactcctgttgccttcatatcgagagttccaagtgttggcctgcagttaagttctga

SEQ ID NO: 1168 - DNA, 27 bp, Artificial Sequence
  Affymetrix ID 2697262
ggaactgcatgaagagcacatggctga

SEQ ID NO: 1169 - DNA, 99 bp, Artificial Sequence
  Affymetrix ID 3829727
gttctctgccaagtgctggccagaggcgcgtgtgttggtcctggtcccccgctttctcccccactgtcctgtccctcccctccccgtgcagctgctcag

SEQ ID NO: 1170 - DNA, 38 bp, Artificial Sequence
  Affymetrix ID 2566885
cctacgaggtccatggcagcgggtacttgaaggattta

SEQ ID NO: 1171 - DNA, 27 bp, Artificial Sequence
  Affymetrix ID 2644609
ggctttgaggatctctgtgccactttg

SEQ ID NO: 1172 - DNA, 586 bp, Artificial Sequence
  Affymetrix ID 2681773
tccttacgaggctagagattttctgacaacagtatgttagtttcatttggtccgtgaatggagatggcagcaaatattctcagaccctcccagatctggctaagacatccccttatttaggaacgaccctcccctggcataccctactctccatcgcctgttggcaataaacgtgccttgtggatattccttaaaagccttcctgccatccctctagcagtcactgtaaagttcaaatctcaaagatgcttaggagccaagattctctctgctcgtgcccagcagcccctgctgtgagctcactgccttccccagcacgacctcctaggctgctgccttcctttctgttggagtctggagtcaggctaactcctaaaaatctgcagagaggtctctggagggaggacccaagcctgttactacctaagccagaattttacacctagtttccttgaatagagaagtccaaccccagaggtgtgcacacacacccgccctgcaaatcagtgacggggagaaagcctgacttttcttgggttttgctagtgggggaaattgctcatttggaagggcaccagcaagctta

SEQ ID NO: 1173 - DNA, 146 bp, Artificial Sequence
  Affymetrix ID 2941811
gtgtcgcttttattctaactgctggaactatttgttgtacctctttctgaagatcagtttggggctaaattacaagctccatcagcacaggggccatggctgcctcctgactgctgtaggctgagcacttggtagagcatcagccc

SEQ ID NO: 1174 - DNA, 76 bp, Artificial Sequence
  Affymetrix ID 3037970
tcacctaaaaggacgaatccatctgcttctgtctctggtactgagggctttttagattccggaggctttctgaaga

SEQ ID NO: 1175 - DNA, 30 bp, Artificial Sequence
  Affymetrix ID 3235439
acactttgacggatcgtttttgtcagatga

SEQ ID NO: 1176 - DNA, 98 bp, Artificial Sequence
  Affymetrix ID 3670576
ccaaggtcacacaatacgaggtggggtcagaatgcaaacccaggcagtgtgcctacctagcccagactcttaaccactaagatgtcactaaagaagca

SEQ ID NO: 1177 - DNA, 28 bp, Artificial Sequence
  Affymetrix ID 2682104
ggagatttggagtacttggagcatggag

SEQ ID NO: 1178 - DNA, 349 bp, Artificial Sequence
  Affymetrix ID 3809910
gggaccttgtccctctttgcatggagggatggtttctttaggtcctgggggatagcccaggccacttccactctgaagatctgtgttctttatcagtctttcaatctagtatatttgcatttaataggtgacaaatgggcctggaagctgtggtggggatggagtgggaaaccagctctcagtctgacattgactcctggaggggagggtcacctctgttcctgggcagcctttcagtggcgaaggccaccatcccccacagcgtgattgagaagcctggcacttctgcaatgagtactgtggagcctgacctttggctagtagcttggtctttattgacagggctgtc

SEQ ID NO: 1179 - DNA, 465 bp, Artificial Sequence
  Affymetrix ID 2428310
cccgggtctgtcataaccgcaaatttctataccactctgctgctttaagatatcaacaggcaaaagataaccactgtccaactcacataaaaataggacatcaagttttgggggacttcatgtcctacctccagcttactaagcctgctatctctggagattccactactgcaaacctagttaggcaatgggtaatagcattacccattaagccaaatgtggagtgaacaataataataatcactaggacttggagagtcactaaataaagatttgttgagtaagtggaggaaggctgccttctaagctgtgtatcactttggccccaacctgcagtactccttcccactgtagccactgactcctgctcccagcttcaaaggctaggatcctctcataaagaattaccaaagccagagatccctacctgcctaatatatactgatgcctcatgtgggcccttga

SEQ ID NO: 1180 - DNA, 40 bp, Artificial Sequence
  Affymetrix ID 2429289
tgtggtttgattagtaactaccctggagtgtctcaacttt

SEQ ID NO: 1181 - DNA, 135 bp, Artificial Sequence
  Affymetrix ID 3246430
acccgatgttgacagtttctccctccctctctctctctgctgtttcctctatagagctaagtctggtttgcattgaaataagcatgcagtaatatgccttttgccttaccaacttgtatttgcacacaggcagca

SEQ ID NO: 1182 - DNA, 25 bp, Artificial Sequence
  Affymetrix ID 3314235
gtgtcctaagcgggtgcatgtccag

SEQ ID NO: 1183 - DNA, 25 bp, Artificial Sequence
  Affymetrix ID 2332841
tggagaagagcccggttgcattttg

SEQ ID NO: 1184 - DNA, 25 bp, Artificial Sequence
  Affymetrix ID 2452077
catggtgatgcatattcggggcttg

SEQ ID NO: 1185 - DNA, 461 bp, Artificial Sequence
  Affymetrix ID 2592323
atagagggttcttgcagctgtccaaggtagaggcagtggaagcttgcgctcagtagaatcagtggaggtaggaagaggtggacagattcaggttatgctttggatgtgataccaatatagaaggatccttatgttgaaggattagatgcaggagtgagagcagaaagtcaaggatggctctacagcagctactagaaccccttgaaaaatggtaatgctgtacacggagctgggaaggcaaggagggggcaggggcaggagttttgtaggactcaataggtttgtggagagaaaaggaggctgatgggaaaatcaagggctttgttttgagcaacatcaagatacctattaaatattcaaggcatcaaacagtaaatgagtcagagttgtactagtatcaagatttttgatcattgttttattaatcctaatacaaaccttcctagttgtcagggttcagc

SEQ ID NO: 1186 - DNA, 120 bp, Artificial Sequence
  Affymetrix ID 2895598
atgttctcggaacaaggaaccagtaaagtacagacatctggccccaggattttgctggctccagggacgtcactataaacccactaacactaattgctttcacgtctgctcccatttcta

SEQ ID NO: 1187 - DNA, 385 bp, Artificial Sequence
  Affymetrix ID 3578431
catgcgaaagcaacagtctgatctccaggttatgaaaactataattaaaaagtcactacacagaaaaggtccaagtttccagcttggcaaaacttgggtgcagttacatgaaacgtttaataaactgaattgttttccccaatgtgtaaacaaaatgacaagactaaatctgtgcctggtaatttcaatctaactctgaagctacacaaaacacacagacaccttgtacatttcacctgttagtatgaccatcttttttcttcggtggtggaaggaagggcaaggtgactgtgtaaagcaaagatgtgggaagtagaaatattgtttactagacattataaagtcatggtgaaaagaaagcttcgattaatgcatagcctaaggg

SEQ ID NO: 1188 - DNA, 240 bp, Artificial Sequence
  Affymetrix ID 3590373
tcttgtggttccttaacttgtggcagcataactccagtcttcacatgaagttcttcctgtgtgtgtatctgagtcctaatataaggagactagtcatattggattggggtccatcctgctctgttaatgacctcatcttagctgctgacatctgtaatgactctattaccaaataaggtcacagtatgaggtagtaggggctaggacttttaacatacgaatattgggaggacacagttc

SEQ ID NO: 1189 - DNA, 252 bp, Artificial Sequence
  Affymetrix ID 3277334
tgcctgcttcacacaagtcgaactgcaactgggatcttggcttcttgtcaagtcagtagcatgcaagccagtttaagtcaaaagaggacacactcctcttacttgattccccttgccatctattttctccctcaatcttagccacttggagaagaatttaataccttttttttttccagagtccaaaggctgtggatctaagtggggcattttgtgctcaagcgaatctgccatgcactacggtttcaactc

SEQ ID NO: 1190 - DNA, 86 bp, Artificial Sequence
  Affymetrix ID 2323027
gagcggtatcttgaaggtggctttaagtttgggaagttcgggaagagcagtaaaggcacgatactgggactgagcccagtaggagt

SEQ ID NO: 1191 - DNA, 27 bp, Artificial Sequence
  Affymetrix ID 2360843
tgtcagcagatgtcttgggtcctgagt

SEQ ID NO: 1192 - DNA, 32 bp, Artificial Sequence
  Affymetrix ID 2834307
gaataaacaaaagtgcgtggagcgcaatgaag

SEQ ID NO: 1193 - DNA, 28 bp, Artificial Sequence
  Affymetrix ID 2890310
aagaagaaaacgtgggacaccagcaggc

SEQ ID NO: 1194 - DNA, 40 bp, Artificial Sequence
  Affymetrix ID 2510000
gataatgaagccaacgcaaaaatccacgtctccaggctaa

SEQ ID NO: 1195 - DNA, 410 bp, Artificial Sequence
  Affymetrix ID 2575065
tctttccagctcatgtctcccggggggctgggctgtctcctgtcctgcagccgcagcacttgatctcagcaggtggaatgcagagcagaggaatccgccagacattacagggatctatctgagtataaaacgggactgctctttccactaaattgcttttggagaataaagttaagtgaattaaaatttccccagtctcaattgctaatatggtaaatattcgcagttacaactctcattaacaaaatctcttaggagtcctcagtaatttgagactgtaaagacgtcttgatactacaatgcctgagaacgagttctctggatcttacctgcccctcttacatgaggaggcaccctgatgtctgggtggcttaccctttggcctctggcgggcattcagcatgagtgaa

SEQ ID NO: 1196 - DNA, 77 bp, Artificial Sequence
  Affymetrix ID 3336723
tttaatgtagagtatattcagcggggtggcttgagagatcctctgattttcaagaattctgatggactcggaataaa

SEQ ID NO: 1197 - DNA, 33 bp, Artificial Sequence
  Affymetrix ID 3660063
catgctctgacgctctatgccactgctgcacct

SEQ ID NO: 1198 - DNA, 55 bp, Artificial Sequence
  Affymetrix ID 4029263
taaaagactgaacaagaagggcacagtgttcacggagattgaagtgaacaagaaa

SEQ ID NO: 1199 - DNA, 134 bp, Artificial Sequence
  Affymetrix ID 2663789
gatgaagatttggacccttccattcataatccctttctaagtgaagggagaggctggcttggctgttccttgttattccgaaagccctggtttggggcccatgttcacactggctctcagtctagtcaggtgca

SEQ ID NO: 1200 - DNA, 25 bp, Artificial Sequence
  Affymetrix ID 3743045
gccactctcgtgctgcttgagctgc

SEQ ID NO: 1201 - DNA, 582 bp, Artificial Sequence
  Affymetrix ID 2826559
agcaaagactctcgggaacaccctattacaggaaaatctctcatacctgacctctgcttaacccactcgtgagattaaatgatagtcttcattctctctgtagaatttgctgactgatgctcatgctacattgaatgacagtagactattctttagttttatcttgaacttttattccccccagttactgtagacttaccaagaaacatttgtgtttgtacccaacacactgttatggcacttgatgttgtaatcacatagtttaatgaattattattcagtgaactctgaagataaaaaggcgtttgtatgagaaccaattggctactttgaaatcaagtgagtagccaaaatcaattatggttgaaatagatgagggttaaataattttaaatgattagggaaaaaaaaacaaaaaacacctaacgatctaaaaaaatctgcaataatattatttttcacgtttgtaaaatgtctttctgtgtttaagaaacagaaactggaaatcacaggtgttgttttatgggggtagtttttgcaagaaaaaggaaatagaactttcttcgatagacccacactgga

SEQ ID NO: 1202 - DNA, 82 bp, Artificial Sequence
  Affymetrix ID 2882611
gtgagccagccaagaattctgagtctgttgaccaaggtgccaaaccagagagtaaatcagaacctgtagtttccactcggaa

SEQ ID NO: 1203 - DNA, 53 bp, Artificial Sequence
  Affymetrix ID 3044784
gacccacggcaattttgaatacttggaagagcagtctaagtaccctcacacaa

SEQ ID NO: 1204 - DNA, 160 bp, Artificial Sequence
  Affymetrix ID 4016017
tgtaggtattcccatggtttcatccttgaccttactctacaaacacgatttctatttccctgatttcatttctcatctgtatgcttatgacctttctgtcaagtattagattcacatatccaaatggcagctactgcttcacctggatgcctcatagcca

SEQ ID NO: 1205 - DNA, 123 bp, Artificial Sequence
  Affymetrix ID 2872559
ttggtgatgctttatcgacctctgagaatccctttgtgatctgcagtgctactgtggttcacaaaatctgtgttcttgctctccctgatagcatctgacatttgtcatcaggggttggcaatc

SEQ ID NO: 1206 - DNA, 83 bp, Artificial Sequence
  Affymetrix ID 2810393
tgctagtgcaactactgctccatcgatcccttcacatttgtctcctggtttacgagatgtggctcttcgttgtttagaacttc

SEQ ID NO: 1207 - DNA, 25 bp, Artificial Sequence
  Affymetrix ID 3309863
aagtgtagcggcaggcatcctggga

SEQ ID NO: 1208 - DNA, 102 bp, Artificial Sequence
  Affymetrix ID 3349873
gaatgctgttagcctgagactcaggaagacaacttctgcagggtcactccctggcttctggaggaaagagaaggagggcagtgctccagtggtacagaagtg

SEQ ID NO: 1209 - DNA, 26 bp, Artificial Sequence
  Affymetrix ID 3849058
gtacatcattacccggcacagacaca

SEQ ID NO: 1210 - DNA, 27 bp, Artificial Sequence
  Affymetrix ID 2609601
cccctcaaatcttacagctgctcactc

SEQ ID NO: 1211 - DNA, 300 bp, Artificial Sequence
  Affymetrix ID 3489275
tctcttgattagtctaggtggtggtttagttctgttctgattttttatttgttttagagatggcatcttgcgatgttgcctaagctggactcaaactcctgggctcaagtgatcctcccacgtcagcctcccaagtacctgggactgtaggtgtgcaccactgcacctggctgtctgctctgatctgcaccactgcacctggctgtctgctctgatctttattatttcttccactaattttggatttggtttgttcttgcttttgtagttcttgagatgtgcattgctagattgtttatt

SEQ ID NO: 1212 - DNA, 412 bp, Artificial Sequence
  Affymetrix ID 3490771
tctccgtattgcttagggtggtctcgaacttctgacctcaagcagtccttcggccttggcttcctgaagtgctagagttacaggcgtgagccacagcacctggcctacatattacatttaagtctgtgatgcattttgaatttttatgtcaagtgtgagatttaacttgaggttcctttttgtggggtggatagtatgttcgggtgttctggcacctatcttttctcattgaattgcttttgcacctttcttaaaaatcagttgagcgtatttgtgtgagtctatttctaagttccccactgtgttagattgagctgtatgtgatctatatgtatgttcctctgtcagtcccactgtcttaagctgtagctgtttaagtctgaaattgggcagactcattcctcctacttta

SEQ ID NO: 1213 - DNA, 290 bp, Artificial Sequence
  Affymetrix ID 2353513
taatgtcatcatcagtgggcaagtctagaaccctaatatcctggtgctcaaaattagtgttatcaattcagtcttctccacattaaacaatttccaattcctttgaggcctggtgtgatggattctgtctttcaaatgctttttttctttcagtgactctatcgttcataaatgttaaataaaaccctcactctgttataaaaatatagactttaaaaattttccaaagtaaacactccagagaaaggtaggcgggctgaataggctgctgttgtccttcttactgccca

SEQ ID NO: 1214 - DNA, 25 bp, Artificial Sequence
  Affymetrix ID 2610157
catctgtgtgaaggagcagatccca

SEQ ID NO: 1215 - DNA, 106 bp, Artificial Sequence
  Affymetrix ID 3092298
tggggagcttgtgcacttgttctcacaggaaacacagtcatctttgcaactatactaggctttttcttggtctttggaagcaatgacgacttcagctggcagcagt

SEQ ID NO: 1216 - DNA, 33 bp, Artificial Sequence
  Affymetrix ID 3241630
taaagaaaatcgaccagaagcagtgaaaagttg

SEQ ID NO: 1217 - DNA, 151 bp, Artificial Sequence
  Affymetrix ID 3489976
ctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatga

SEQ ID NO: 1218 - DNA, 115 bp, Artificial Sequence
  Affymetrix ID 3671050
ggagaacgtgccctattcacactctgggaagacgctaatctgtgacatcttttcttcaagcctgccatcaaggacatttcttaagacccaactggcatgagttggggtaatttcc

SEQ ID NO: 1219 - DNA, 30 bp, Artificial Sequence
  Affymetrix ID 2476149
gtcagttagacagagtccacaagggagtcg

SEQ ID NO: 1220 - DNA, 26 bp, Artificial Sequence
  Affymetrix ID 2670672
gaactcacggtcttcagccttcctgc

SEQ ID NO: 1221 - DNA, 25 bp, Artificial Sequence
  Affymetrix ID 2792848
tggccatggtgaaacagtgcctcta

SEQ ID NO: 1222 - DNA, 28 bp, Artificial Sequence
  Affymetrix ID 3168127
ttccaatcagcagtatcatggattaaat

SEQ ID NO: 1223 - DNA, 188 bp, Artificial Sequence
  Affymetrix ID 3227785
gggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagca

SEQ ID NO: 1224 - DNA, 443 bp, Artificial Sequence
  Affymetrix ID 3367153
cttgtatgaccctttgtctcggttgactagttgtttgctctaagaatatttcatgttttgctgtttctttcagtttgtaggtgctaagctattgaaaggtttagagactaatctaggtctttctaaattatggctgcttgcagttttattcctggagaaatggtttaacagcacttctttgagttggcactcttctgcctgtctcagctctaactttcccgcctccttctcagtagtccctctttcaccctccactccccaagcctgaaatggaaagaacttgctttgttactgatgataatatttaagctctaaaattttaacagtgtttcagttgcaaataaatggaaattgtgtattctgtttaatgtgtttcagaaaatccctgctattttttttttctttaaatacaagaaaacaggcgtgtaatgcctcattgaaaa

SEQ ID NO: 1225 - DNA, 167 bp, Artificial Sequence
  Affymetrix ID 3483227
tttagtcaagtaggttgagagcaccagggatcattttttcttcaaccttttagctcagtgatacccagagcaatgtgcctactcagtggagaagatagtatttgtgtgaataaatttactgttctgtgtgttacatgtctagttaggagtggtcctctaattctgta

SEQ ID NO: 1226 - DNA, 83 bp, Artificial Sequence
  Affymetrix ID 3766878
aaaatgtggttccttgtgttctctctgtaaatggggacctagaccgaggcatgctggcctacctctatgattctttccagctg

SEQ ID NO: 1227 - DNA, 133 bp, Artificial Sequence
  Affymetrix ID 2555150
tgggcgtgaataaggaagcaaaactcaattataataacattactattgttcaaacttcacatggcacttgcaaccggaggctactttgtctgcctgtctccatactcatgctgtcttatgctcatgttcttca

SEQ ID NO: 1228 - DNA, 106 bp, Artificial Sequence
  Affymetrix ID 2601747
gataccacttcccactcgtcttccaaggggggtggaggagcgggaggaactggtgttttcaagtccggctggctctacaaggggaattttaacagcaccgtgaaca

SEQ ID NO: 1229 - DNA, 76 bp, Artificial Sequence
  Affymetrix ID 2664745
ttatccaccgcacatgaaagagagctcagcgccaactgccagtccactgaagggtgtcgcagtgatatttgtttga

SEQ ID NO: 1230 - DNA, 140 bp, Artificial Sequence
  Affymetrix ID 2698409
atgtgctactaacaggtcaggagcccagatcaaagagctggtttgggaggtggataatgaaggttgtgaagtctgtgctccctctgagaagcctgaggaaaatgcaggtggctccctcaatcaacagacatccaaaatgg

SEQ ID NO: 1231 - DNA, 65 bp, Artificial Sequence
  Affymetrix ID 2704917
atcagcagattcctcttcattcaccaccttccaaagtttcccatcatcagctgatattacaacag

SEQ ID NO: 1232 - DNA, 38 bp, Artificial Sequence
  Affymetrix ID 2823922
aaatgggattgtccatcgtgatctcaaaccagagaatc

SEQ ID NO: 1233 - DNA, 32 bp, Artificial Sequence
  Affymetrix ID 3717013
ggtctatatgtctgtacttatgctggtaccac

SEQ ID NO: 1234 - DNA, 92 bp, Artificial Sequence
  Affymetrix ID 3498270
atgtccagcgcaaggacactgtccagccttctcttcctgcacatcagctgcctcccgtcagtcctgctgaacggggatccttcccagatttc

SEQ ID NO: 1235 - DNA, 216 bp, Artificial Sequence
  Affymetrix ID 3737381
cttcaaagggtgtccagatgctatgaagcattgggttcgacttggggtccacgtggtttgtgcctcagggtccaaaaccacctgcattctaccggtggcgtctgcagaagacgaatggcttgaaggagctggcactccgccggctagatgatccaaaccatttcatttctttgtcgtgtggaaaaggccctctgtgatgcacttctgttctctgga

SEQ ID NO: 1236 - DNA, 308 bp, Artificial Sequence
  Affymetrix ID 2512319
ctgtagctttgagtttgcaccgttccttgtcccaggaaaaagttaagaaacttaaaatgttttgttttgcttttaaagaagacaggacagaaaacgggatttaaaacttagtttttaaaaaaacaaaagctacagagtagggagcataggtcaaccatctccacctaaattttttttgttcctaaactcagaattctacaacccaactaaattaatatgccaagattttgcggatgttaaaactcaaaaaaagcagtatgcaagacggtcccggggtaaaattctactgcctttccacggacaagtta

SEQ ID NO: 1237 - DNA, 323 bp, Artificial Sequence
  Affymetrix ID 3596425
agtcctcgctgtagcatggggtaaagccaggatatgacttcacatagtttaactccagaacttacactgtcatcttgttttgtttttctgcttctcttgtgtgtcaaaagaattcctccttagttgttctcatatggggcaaccattaaattaggcagtgtaaaaaacaagttatgcagaataaagtagcaagagcaatctactctgaaattagtgttttccctcactttagcacctttagctgacccagcttcctaccgcccagacattttacaaaaatctctctctggagttgcctcctgatctggattaggagtcacata

SEQ ID NO: 1238 - DNA, 71 bp, Artificial Sequence
  Affymetrix ID 3809494
ctgtgtttaacacggctgtgctacttcaggctcccatctcgctgagggtgcccatgtcagccaatgacctt

SEQ ID NO: 1239 - DNA, 423 bp, Artificial Sequence
  Affymetrix ID 2442446
gtcttttgcagtaggtcagggctaagaggactaatccctcaagagtgaagaaaaaaactattgatggtggcttgaaagagtcaactgctgtagcttttcttggagatgatcacaaaatggggagcagaaaacaggttgaaattacagaagattaattagtaagaaaagatgggttaaagatgtaaattagaggcaaagttaagaagaatttggtttcttcattatactcagaaaggtaaggatggaaaagttgatggagcaagattgtgaagtatcttatatgcaagactaagaagtttggactagattctgaagacttaggagaaccagtgaagaaatcttaatagaggaatcggattagatcttagggtcagaacaattattagcaagcagggtaggtgaagttcctgttgacccactttg

SEQ ID NO: 1240 - DNA, 290 bp, Artificial Sequence
  Affymetrix ID 3281111
agcatctgtcgctggtgagaccctcaggaagcttctactcatgttggaaggcagtagggagctggcatggcttggcgagaggcaaggaaggagaggggaaggctcttttccataagcagttctccctatggcaccaagccatttatgagggacccacccccatgacccagtcacctcccaccgagcaccacctccaacattggggatcacattgcaacatgaggtttagaggggacaaatattcaaactgtatcactgggagatggggctaccggaagtcaagccattcc

SEQ ID NO: 1241 - DNA, 31 bp, Artificial Sequence
  Affymetrix ID 3770080
ctgtactaagtgctgatgtgccagcgctatg

SEQ ID NO: 1242 - DNA, 260 bp, Artificial Sequence
  Affymetrix ID 3821078
acagatgtgatcaaaaggcctaatatatgtgtaattggagtcccaggagtgaagagtgaaaatgaggcagaaaaaaattcaagtgagaatggctaagaatttccccaaactgatgaaaggcatccacccacaaatcccaattttgtacttccaaccactgttataccacccccctcaacaatgcctataaatgtttgttgaaaatgagtgaatgaatgtactccaatcattttctcacttggatgttccctactttttgc

SEQ ID NO: 1243 - DNA, 68 bp, Artificial Sequence
  Affymetrix ID 2531265
ataatagcaaagccgacggccaggtggtctccagtgaaaagaaggcgaacgtgaatctgaaagacctt

SEQ ID NO: 1244 - DNA, 67 bp, Artificial Sequence
  Affymetrix ID 2719554
actggtggctcgatatgtgtccttgattcccttcttgcctgacactgtctcatttggtggtatctgt

SEQ ID NO: 1245 - DNA, 192 bp, Artificial Sequence
  Affymetrix ID 3342924
tgaggtccacaaatcagtcaagttgaataaagaggaaattctaaggaaaatattaaaaattacagaaagaggaagctggggacactgagcataaactttgatgacatcaattttaccgtgtgcctatccactattcctccacttagtttctcagatcttgccagcaaccttagggcttgcatcctccatttc

SEQ ID NO: 1246 - DNA, 42 bp, Artificial Sequence
  Affymetrix ID 3811421
gtacgtgtgagtgcgctgtataaagtctggaaccacaattag

SEQ ID NO: 1247 - DNA, 27 bp, Artificial Sequence
  Affymetrix ID 2448106
ttgtgtgattgcaatgctgaatttgtc

SEQ ID NO: 1248 - DNA, 26 bp, Artificial Sequence
  Affymetrix ID 2661177
ccttgttcccacatcggcacattatc

SEQ ID NO: 1249 - DNA, 424 bp, Artificial Sequence
  Affymetrix ID 2748212
aggcattttttgtccacacacttgctttggggatttttattaggtagacggtaattagaggtgtcagtcatatgaaagtaaatcactagtctttcgtattactgttttctcagtggtccttatcagttttttttgttgctctgtaatcattcatatggtaagacttaacttttagtcatgtaaatttgtttagggacaatttaaactattttgtcaaattagtcgttttattccaagttgtacgtcttatgcatttatttagtatagtgaaagccttatatacacatttaatataattagtctctggatatttggattattttttagtagtacttttttagagtgtgggttttttcttttcttttctgtttttgagacagtgtctggttctgtcacccaggctggagttcggtagcccagtctt

SEQ ID NO: 1250 - DNA, 325 bp, Artificial Sequence
  Affymetrix ID 3081649
cacctttgtgcatgtatatacttcaagttgtatgaatttctttatgcaaagagcctttaaaatataaactgtgatttttgtttctaattttttactttggattgacagggccttttttcaagtgttggaatttccttttagatttcttatcagagtttatcttgattttactgaaattcatttagctatatgaaattcctttagccatagtcttgattcagatccccccacctgagtctttccaggaccttgtgccatctgttattgccattgttgtattcacttacagcctcttctccatgagtacaagcccaccatcatgctc

SEQ ID NO: 1251 - DNA, 51 bp, Artificial Sequence
  Affymetrix ID 3415065
gagccattcctttggcaactcttgctgtcagccatcttccaaagagctttg

SEQ ID NO: 1252 - DNA, 257 bp, Artificial Sequence
  Affymetrix ID 3436225
tgtctaccatgttgggcagcacagatctaaagcatttagaaccatggctagagctatgtgtttactatcattgcttcaatatggagagtcatccaaacaggtttcatttgctcccagataaactgtcatgggacctgccgtggccagtgctcaccttgtactgctggaataatttaacaatttttttcaactgccatcatcatcatgccattttatgtcttcgtagcatttatcactatctaaaggtaggtcgctta

SEQ ID NO: 1253 - DNA, 39 bp, Artificial Sequence
  Affymetrix ID 2546677
ctcccaaactcttgaggacatgtggggaactacagctgg

SEQ ID NO: 1254 - DNA, 49 bp, Artificial Sequence
  Affymetrix ID 2723423
aaggtagtgtgcaaagcgaaaagagggcacagaccaaaatcatgcaaaa

SEQ ID NO: 1255 - DNA, 25 bp, Artificial Sequence
  Affymetrix ID 3291647
gtgggttacatgttcctgcctggca

SEQ ID NO: 1256 - DNA, 82 bp, Artificial Sequence
  Affymetrix ID 3449366
ggacctcaaccggatcatccaggcgctgaagggcaccatcgacccgaagttgcggattgcagccgagaacgagctcaaccag

SEQ ID NO: 1257 - DNA, 27 bp, Artificial Sequence
  Affymetrix ID 2935290
gttttacaacacccaaagcaacagaaa

SEQ ID NO: 1258 - DNA, 80 bp, Artificial Sequence
  Affymetrix ID 3296065
gttatggtgatctgttctgcaaagctctgaaaacatataatatgctttgttttggaatttaccggctgagagatgctcac

SEQ ID NO: 1259 - DNA, 34 bp, Artificial Sequence
  Affymetrix ID 3414403
tacggtgtactgtcctactgatgctggattacca

SEQ ID NO: 1260 - DNA, 39 bp, Artificial Sequence
  Affymetrix ID 3611215
ctagtctagggatagtggtagaagtacgtaatgtagatg

SEQ ID NO: 1261 - DNA, 34 bp, Artificial Sequence
  Affymetrix ID 2997513
cctttgctctctcatatgcatccggcacagcagc

SEQ ID NO: 1262 - DNA, 42 bp, Artificial Sequence
  Affymetrix ID 3180413
ttcaagggcataggcgtcggaattgtgatttcgtgcgtgttt

SEQ ID NO: 1263 - DNA, 28 bp, Artificial Sequence
  Affymetrix ID 3732510
gaaccactttgttgaccttctgctgcaa

SEQ ID NO: 1264 - DNA, 448 bp, Artificial Sequence
  Affymetrix ID 2572597
ctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaaacaatggatcctgtgtgtgtgtactaccatagaatgggccccaagatgcatgattaagtgaggaaaaaagcccatggtatcctaatgtttggaatggagaaagtgtgtagatgtatgtgtgtgcatatgttttcacacagacgtatacacgtgtatatcatatgtccacctgcatatgcctaggatgtctctgggaggatatctagcagcccggcagcctgaattgcctctgggaa

SEQ ID NO: 1265 - DNA, 231 bp, Artificial Sequence
  Affymetrix ID 3216409
aggttctgaagtcccaggcaaatgtaatagggggtaggcagaggacttacttagagagatggtggtgaaagtctcaaactgcagatttctagaacaaacaggttacttgtaagaagcagacagagatacttagatcagtaaaatacttctgtaacactagaagtgagaagacatgagaacgttatctagaaactatcaagaggaaatgactgcagaccaaaaatcctacgc

SEQ ID NO: 1266 - DNA, 562 bp, Artificial Sequence
  Affymetrix ID 3294290
tccacagctcgatttggccaatttcgagttgaaaggatggtactggacccaggcctcataagtagcttgtcatcaagatctctagtagccaaatcagaaacccacaatgaagtaaagatcagtatgtcaaggaagacaagactaacggggtaaaaagccttagactagaaactacatttagggggaaataaagcaaaaataaaaacctttcaataagtaacactagtttccagatggtactctagctcaggcatgagaatctgttcttaaaagtgggacattatttcaatcataaacataatttactagaatggacatttggcaaagcaagtccattatccacctgccatcacagtcacttttttagtcaccagtgaaggcaagcctgaaggacacctactccaaagtgcttcccaaaaatttgccacaggggctgattcctactctgtttgaggcattcttttgtgctgaaagattgtcaccagaaagacaactgaaagacaaatattgctgcttgggagcagttgtggcaccagtgtggctcccactgtagcaattaaag

SEQ ID NO: 1267 - DNA, 225 bp, Artificial Sequence
  Affymetrix ID 3446505
gtcttgtagcactcaaacctttgtctttcccacaagactgaaaactccatgacacaggaatatttcttatcctgtgaacctttgtgtcataccacctatagtagtgtttagtataaaataaattaattgtttggaaatctatcctaaaaaaaaaaacctagattcagtaaaagctctgtggccaaggatgtttgtgttacagtgaacaccttcgagcacttcagg

SEQ ID NO: 1268 - DNA, 54 bp, Artificial Sequence
  Affymetrix ID 3616936
ctcatagcatggtggtctcgcagtagttagccttcttacatagttactggcttt

SEQ ID NO: 1269 - DNA, 43 bp, Artificial Sequence
  Affymetrix ID 3628351
cctccgttacccgtcagcccagcatccggctttgcttccataa

SEQ ID NO: 1270 - DNA, 269 bp, Artificial Sequence
  Affymetrix ID 2745112
gcaaaattggtctggtatctgtctaaattggtcaatacaagtgttattctggaatcatgtaaaaatcacttactttcataactgtttagaaccccaaatgttttccctttgaaggggaacatctgtggaatatgattttgaatagaggacttctatgaaatatatttcaaatcttaaaaatatttttaatacttcctaaagtggtataggatttaccctcgctgactatgccttccatttaagaacagtcttgcatttgtggcttttca

SEQ ID NO: 1271 - DNA, 79 bp, Artificial Sequence
  Affymetrix ID 2824232
tgtccctccgttcttatggaagccgggaaggatctgtatcaagccgttctggagagtgcagtcctgttcctatgggttc

SEQ ID NO: 1272 - DNA, 26 bp, Artificial Sequence
  Affymetrix ID 3101817
agttctggtttcagtgggaagaagtg

SEQ ID NO: 1273 - DNA, 225 bp, Artificial Sequence
  Affymetrix ID 3129414
cctagctgtctgtcaggtagaatgagggtgaaggagatctaggatgcttcaggcattgcgcttgaacttaaaaaacaggatcagcaggccctgacttcataaggcccataaatacaaatgactagctccctttctcaaggtcattgaaaatatacagtagtttcagacatcacatgggtttgggcaaagggggcagatttccaagctaggtcacttaatggtatc

SEQ ID NO: 1274 - DNA, 137 bp, Artificial Sequence
  Affymetrix ID 3576514
gtggccgggaggcaaaacttctctatgagtggaaacgtttgaagaatacatcacccattacgattttgctaatcttaggtttcagacaccacagacacattgattctatttggaaagatagccatcaatcagccagc

SEQ ID NO: 1275 - DNA, 66 bp, Artificial Sequence
  Affymetrix ID 3650814
ataaagaaatttcgggatgaagagcttgagcaccatgacataggcctcgaccatgatgcagaattg

SEQ ID NO: 1276 - DNA, 284 bp, Artificial Sequence
  Affymetrix ID 3723777
gccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgct

SEQ ID NO: 1277 - DNA, 34 bp, Artificial Sequence
  Affymetrix ID 2550931
atgcacatgggacagtctaagatggtagtggtgg

SEQ ID NO: 1278 - DNA, 27 bp, Artificial Sequence
  Affymetrix ID 2681842
accaagtgacattttgcattcagcctt

SEQ ID NO: 1279 - DNA, 25 bp, Artificial Sequence
  Affymetrix ID 2868846
gctctagtgccacaggaagctgcct

SEQ ID NO: 1280 - DNA, 27 bp, Artificial Sequence
  Affymetrix ID 2880139
agccaagggagaacccaagacagagaa

SEQ ID NO: 1281 - DNA, 28 bp, Artificial Sequence
  Affymetrix ID 3309073
attgaatgattgtttagaggcagtgtga

SEQ ID NO: 1282 - DNA, 27 bp, Artificial Sequence
  Affymetrix ID 3636536
gcaattcagcaacagagctcttcagaa

SEQ ID NO: 1283 - DNA, 105 bp, Artificial Sequence
  Affymetrix ID 2347802
gggatacattcaggtctcagttgttgaggctgttgagcagcaatccaggtatgaaaatgggaaagatttgactgcttctctcatgcaggggaataaagcaaaggc

SEQ ID NO: 1284 - DNA, 239 bp, Artificial Sequence
  Affymetrix ID 3202177
tcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactga

SEQ ID NO: 1285 - DNA, 59 bp, Artificial Sequence
  Affymetrix ID 3945822
aaggaagcgagagacttggcagtcctgtaggctttaatggaatcagcaatggacgctcg

SEQ ID NO: 1286 - DNA, 118 bp, Artificial Sequence
  Affymetrix ID 2682207
ggggctttaattcttaatcgctgtgaggattgttatccgtgggatgtgagctgtcttagtggtattcaatcaagtgtccacttagccatgactggaagtaattgctcccaagtgggcc

SEQ ID NO: 1287 - DNA, 764 bp, Artificial Sequence
  Affymetrix ID 3263773
agccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactact

SEQ ID NO: 1288 - DNA, 375 bp, Artificial Sequence
  Affymetrix ID 3497166
cgccagcataccagctcatgtttcagaatttctgtcacaaaaaggaacacaatattttaagttgactactgtgggaaagctatgatcattcaataacctacctttctgatagctctttctcagataatataagctataaaccaaaatagtcagccttcacctgatttacagtgccctttgaaacttcctaagttttctagcccagtaaatgctgagctaccagttctacttccaagctagagaacctgtttactaaagttagaagtctagtgacttcctctgtcagactgtcccagaatgctctccctacccccaacaactgtgtaagaaccgtcattagccatctccaaattgccaaagtgctcagtcccttcg

SEQ ID NO: 1289 - DNA, 25 bp, Artificial Sequence
  Affymetrix ID 3618874
gtaacatgcatctgtgtgggaacct

SEQ ID NO: 1290 - DNA, 520 bp, Artificial Sequence
  Affymetrix ID 3202840
tttcactgctactgcgaactggtcctgaaggtgcagatctcttagaaggaggactcccacttcttggtggtggtcctctttttactggatgtggtcccctggaagaactcatgttaaaattcatggaatatccaccgtcatccatgtgtcctccccgtgagggaggtccccttgttcctccacttcctcctcttccacctctaagacctcttggagggcctctacttcttggaggtggaggcggtccacgtctaccactttcaaatgatggtttgttggcttgttccacctcgatggcttttccatctaatgactttccattcatgtctctggctgcatccttagcatctgctgggctttcaaaggtgacaaaagcaaatcctcctgatttgttggtttcatggtctttcaccaagagtacttccactattcgtccatatttgccaaatactgcttcaagagctttctcatttgtttccgtgttaagcccaccagtgaacggctttcctgggcaatctgc

SEQ ID NO: 1291 - DNA, 46 bp, Artificial Sequence
  Affymetrix ID 3755656
cattaggggaccctgcctgaatctttgccaacctgcaaggaaactc

SEQ ID NO: 1292 - DNA, 335 bp, Artificial Sequence
  Affymetrix ID 2469949
tgccagtgacatccttgggttattcgtatacctcatgctttagattcgcttctggttcatggtgccagcccttagaaactctgggttcctacctgaagccggtcttatcaaaacgccacccctggttccagtttgatcagggtaaccttgtgaattagcaagcagcagtccccagtgtgtgctgacatggaggttggagagaaaatagatatgtcccatgcctggtttccagccaatactgatgtcgcgggttagtccagcaggctgaggctgaggcctgtgacaaagtccctgcatggaggtcttcctgcgtcagagcctagccctgttcaata

SEQ ID NO: 1293 - DNA, 25 bp, Artificial Sequence
  Affymetrix ID 2830605
gagctttctaatgggggtgggaaga

SEQ ID NO: 1294 - DNA, 84 bp, Artificial Sequence
  Affymetrix ID 3235906
ttggggttgatacccatcatcgctcttagactcggggttgatactcgtcatcgctgttacactcagggccgatacctgtcatca

SEQ ID NO: 1295 - DNA, 161 bp, Artificial Sequence
  Affymetrix ID 3616555
aggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcc

SEQ ID NO: 1296 - DNA, 25 bp, Artificial Sequence
  Affymetrix ID 3369121
caggaattttggagcgggttgaccg

SEQ ID NO: 1297 - DNA, 34 bp, Artificial Sequence
  Affymetrix ID 3908978
tcccatcagcaacatccgtcataccctgacgccc

SEQ ID NO: 1298 - DNA, 104 bp, Artificial Sequence
  Affymetrix ID 2338495
aagagcaggggacctatgatgcagaaagtcctttgctggagctcacaggtcgaatttcagggaagctgcccaagggcttgaacatccctgctttcaggttccag

SEQ ID NO: 1299 - DNA, 124 bp, Artificial Sequence
  Affymetrix ID 2452931
ccacatagtacggtgtataacaaggagtggtcaaagagttgtggctggtggtttccttggcaaagccaaagtcagtgagtttcaggatggcgttgggccttttggaggtgtataagagattctc

SEQ ID NO: 1300 - DNA, 106 bp, Artificial Sequence
  Affymetrix ID 3448040
tgttaagccttcctgagatcacaccaaatgtccttgatgggaattgtaaacaacccttacttctggtttctaatgatattccaggaaaggagcctaactagagtca

SEQ ID NO: 1301 - DNA, 33 bp, Artificial Sequence
  Affymetrix ID 2823916
gattgtggaaaagggatattacagtgagcgaga

SEQ ID NO: 1302 - DNA, 98 bp, Artificial Sequence
  Affymetrix ID 3799998
gggcatcaagaatttggacatactggtgtctggtatcgaggttcttcagctactcaatgcacgtgatgatggtgatgatcatgatggtaacaacagac

SEQ ID NO: 1303 - DNA, 124 bp, Artificial Sequence
  Affymetrix ID 2978095
tcatgaatattggatggctctgaggaatcgtgtgtctgctgttgatgaacttgcaatggctacagaacgactaagagtgcgtgatcctagggagccaaagcctaatccgcctgttcttcatatc

SEQ ID NO: 1304 - DNA, 187 bp, Artificial Sequence
  Affymetrix ID 3475634
gacacctcaggtgacatgctttatagttggcctgagccttgacccagtggttcaacctgagtttggtcttggtaccattcaggtgtttgtgagctgagactgatgagtaggaacaggtgttttatatctcgtcttttgtcaaaagtaaagactcattcctttggtaacccaaccaaatcaggatcag

SEQ ID NO: 1305 - DNA, 25 bp, Artificial Sequence
  Affymetrix ID 3683092
gtattctgagcacacccaactacag

SEQ ID NO: 1306 - DNA, 1255 bp, Artificial Sequence
  Affymetrix ID 4022048
cgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctc

SEQ ID NO: 1307 - DNA, 109 bp, Artificial Sequence
  Affymetrix ID 3153356
ttttctgaggaatagggctcaatggtgggcttagaatattgagtacaccatgctgtaaacagatatgctgtcatctaggctttgttgtaccatttagagagcacaggca

SEQ ID NO: 1308 - DNA, 27 bp, Artificial Sequence
  Affymetrix ID 3529618
gtggatgtgtttcgtgaagacctctgt

SEQ ID NO: 1309 - DNA, 245 bp, Artificial Sequence
  Affymetrix ID 3830025
aattcattcgcctccggtacttgcaagcctcgctcagtcttaagcaagaggggatggattcgcccgcagcactgagaatccaggggcaggcgggatggcgttcaggcgctgttgctagaaatctctgtctttactctgttttgaaggcagcatggcagggtgaacacaagcacagactgaaggcagcttgccgcggttcacatcctggtcacaccacttcctgaccatgtcacgtgggcaaatta

SEQ ID NO: 1310 - DNA, 77 bp, Artificial Sequence
  Affymetrix ID 3866580
agggatgatcccattccaccctgtccactctggatgagaattggccacctgatggttatttatacgtccagaagaac

SEQ ID NO: 1311 - DNA, 234 bp, Artificial Sequence
  Affymetrix ID 2620390
gccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggcca

SEQ ID NO: 1312 - DNA, 25 bp, Artificial Sequence
  Affymetrix ID 2693884
cagtctgagttcctgcacccttcag

SEQ ID NO: 1313 - DNA, 90 bp, Artificial Sequence
  Affymetrix ID 2724817
gatgatgctggacaaactgcaaatcctgaacttagagactgttgcagcaataaccattttgactgtgataatatcattctgctcaagttg

SEQ ID NO: 1314 - DNA, 78 bp, Artificial Sequence
  Affymetrix ID 3718581
ccagtgacccggaaaaccttcatgaaaaacaactttgaacacatccagcacattatcattgatgacgctcagaatttc

SEQ ID NO: 1315 - DNA, 834 bp, Artificial Sequence
  Affymetrix ID 2645299
ctggcagcctgctcaacactttaaattttatcagtttagtacctgctgatgcgtctaaaactgttggtcccattctagttttatacttacatatgtagtattaaaagcacttaagagaaatgtagaatatataatctttataaaagtattaaaggaattatttaaattgaatttgtatcccatttatcttgcttgctaaatagatttaattggagcatccatttgtataacgtctggctatttctacaatgttaaaacagtgggttgaggaagtaaaatttgagttactcagttactgacatagaaaagaaccctgtgagaccaaattcagctttggaaacaatttagtgtaattattttgcatatgtagatacacctttgaaagccaagaaaggtttatgattggatctgtactatattaatttaaaaacaaattattcttaagtatattgtagcatttctgttcctgtaagtactttactcatcttaaatgtactgatcattagccacctttataaaaagaatgtgcctgacccactagtatttgatagaaatattaaaacagttaagatccttaaacatttctgcatataattttttattgagtaaatgtaacttaacgtaagtagttctatgaagtctgtgtaaattaaaaccctgttttgtgtagatgaagcaatctttataagtttctgtcatcaagactgtattttgtgtgctatttttccatagctaggaaggtggcaagtaaaacatatgcactatcctagaaacatactgttccaggtagatcttaatttactacctggaatgagccatcttaggtgaccacca

SEQ ID NO: 1316 - DNA, 110 bp, Artificial Sequence
  Affymetrix ID 2927067
aatctgtagttgtaatgtagccttctacctaaataaaagagatcctaacataatggttctcattacttaagcctcattatgatcaagctcttcccaaataatctgaccaa

SEQ ID NO: 1317 - DNA, 83 bp, Artificial Sequence
  Affymetrix ID 2434911
ctgagacgatgattagtagaactgagaagtgcccattggttttggtgagatagaggtcagacattaccttagcactttttggg

SEQ ID NO: 1318 - DNA, 30 bp, Artificial Sequence
  Affymetrix ID 2916250
ggctcagaggggtgcgcacaacaaccttat

SEQ ID NO: 1319 - DNA, 63 bp, Artificial Sequence
  Affymetrix ID 3152957
tctggcaaaacccaggtgcggtaaccctgcagcagcttccactcactcctgcaatgcctgaca

SEQ ID NO: 1320 - DNA, 73 bp, Artificial Sequence
  Affymetrix ID 3190622
gaagcttttgagacagacttcaccgtccacaaggatcgcgtgaatgatgtctgcaccaatggacaagacctca

SEQ ID NO: 1321 - DNA, 172 bp, Artificial Sequence
  Affymetrix ID 3508990
ggatttctatgccacactacccgtaactttgaaaaataactttaggctgcagttttcagcaaacaggacagtccttagctgccacatagctcaacataaagtgcacaaaaaacttcacggtgggacagtgaatcataaattcccaaactgacgtgtgtctacagaacagatg

SEQ ID NO: 1322 - DNA, 188 bp, Artificial Sequence
  Affymetrix ID 3567717
ttttccatagcttggttctcaggggttatagatgcaagaagttcctggaaagagctctaaaccagaaaataacagtctgctggtcaaactcaaaactgtcttggttgatatatgagctggctgtctttactgttacctcctgtcatgatcattttgctaattttctgctataactagaggggaatgtc

SEQ ID NO: 1323 - DNA, 203 bp, Artificial Sequence
  Affymetrix ID 3780094
tgcgttagaagacctgccgacaggccggataaggccaatgagagagggaacggagaagaggggcacctgggttcacaggccttaagaaagaatttagttacttatttaacaaattaaacaatgtgtgtcacgcatgtaggtctgggaaatgcattattaaaaacacacagtgcagaggtgcagcaccagcatacgggtggatt

SEQ ID NO: 1324 - DNA, 77 bp, Artificial Sequence
  Affymetrix ID 3799938
ggacaccctcaaccagtaacacacactctccttcttcaatgacgtttgtgttcctagaatccattttcctcagtcag

SEQ ID NO: 1325 - DNA, 204 bp, Artificial Sequence
  Affymetrix ID 3932154
tcttgccatacccaagtagggaatcacttccaggaaaacaagtcctcaagcactcaatgactttgtaaacccatgactgaaacaagactcatctgaggcagtaggactggtgggattctactgacttcttagtatcacatggcaccatcacaaatgcattgttagagcagcaacatccagagttcttaagcttgtaccctaaca

SEQ ID NO: 1326 - DNA, 494 bp, Artificial Sequence
  Affymetrix ID 2534308
cctcacagtgacacgcgatgttttcaaaagtccatctttccacaggatgtttacagcacccagcgggtaggcagtgctatttattaaccctgttgtactgatgaacaaaccagccggctcagggcagggggtgagcttgatcaagatcacagacaggaagtgacagcggggtctcagcccaggccatgcctgacacccacactcttctctggtgggggcgcttccacctttgtccctggaagcccagcctgacagcttctgcagtgcctctggcagccgcccacaaacccagccaggcaaaatcccagggtgccagacaccaggagaaatttccaggggaatttggccatttggctgtctcttcacttccctgaaaagccaaacagagaatggatttcttatcacactgtagcaaggcaatcaactggaaaagagacaggaggagaagtgtgaggaccaacagtcacagggacccaggaatcgtgttagccaca

SEQ ID NO: 1327 - DNA, 70 bp, Artificial Sequence
  Affymetrix ID 3696944
gctcccaaggcccaatcagatacagctctccaaacctgccagtgctggtgaacgcgctgctgggagcact

SEQ ID NO: 1328 - DNA, 25 bp, Artificial Sequence
  Affymetrix ID 3712853
ggccgtgaaggaagaatgcggtgtt

SEQ ID NO: 1329 - DNA, 272 bp, Artificial Sequence
  Affymetrix ID 3916807
ttcaccaggatacgactgttggaccagctgctggagatggacctgctacccctcagcagcctccccaccacaagacaagtgatctcaatgtccccaaacctgtgggaccctgttctacacacctcatttttgttccggcgtttcatcctccttgtgtgattgtactgattttcatgagacacaagttacttctttacatccatattcccaaagcagggttacatggtaggaaagaaaggaagttggaggtactaagctcattgtgtctcctc

SEQ ID NO: 1330 - DNA, 180 bp, Artificial Sequence
  Affymetrix ID 2381295
aggaagtaactagagccggcatttgggggtgttgcggacgattcttacgaatccagacaatttgctcttttaaacgcggccttgcggttgtctaacagtgagaatagatgactaactgaatttgtcagactccctgccttctgtcataataacgacgcagaattgccaccgttatgtgtc

SEQ ID NO: 1331 - DNA, 25 bp, Artificial Sequence
  Affymetrix ID 2608169
gtatggggagaacgaggatgtgata

SEQ ID NO: 1332 - DNA, 82 bp, Artificial Sequence
  Affymetrix ID 2363544
ccacaagaagggctagagaaatacagagatatttgaagagtgtgaggaagagtattaacacaccagttttcttgatcaatag

SEQ ID NO: 1333 - DNA, 317 bp, Artificial Sequence
  Affymetrix ID 2407863
acatccttcttttcggccttgaatcctttcttgctttgcaaggaacaattttcttcctactataaactacagcactaaggtatggaccttagaaattatatagtctaattctctgctgacacacaaatcccttcaacaacaaagaatcataagttcacattgaaaggtctctccaaatctcccataaatctacaatattcttgatgtttaaaatttaggataatagagaattcactaattcataagacaaagtaccaatgtaataattctataaaatgtcataatctgctttccttgtaacttctgcctattgactc

SEQ ID NO: 1334 - DNA, 41 bp, Artificial Sequence
  Affymetrix ID 2920969
aggatcctcgggcttatttcgagcggtttcagcttttggtg

SEQ ID NO: 1335 - DNA, 42 bp, Artificial Sequence
  Affymetrix ID 2949119
tgcgtggtgcgagtgcgtgaatattgggggcccggacgccca

SEQ ID NO: 1336 - DNA, 66 bp, Artificial Sequence
  Affymetrix ID 3241194
cattgggccttccatcatcagaaagctcctcatgccacatcttgacacattattcccgtcctcctg

SEQ ID NO: 1337 - DNA, 168 bp, Artificial Sequence
  Affymetrix ID 3447084
aggatgtgagactgccgtggatatcagggaagggagacttataagaaggagaaatttggtcaactgtgtcaaatgcttcagcgatcaggatgagtaatgaggaacggccatttgatttgatttgatcattcagatatctttaaagacctttaagagggcagtttcagt

SEQ ID NO: 1338 - DNA, 114 bp, Artificial Sequence
  Affymetrix ID 3626136
acgaccatgcgcactgagaaacaggcaccaggatgtcgagaacggcaatgtatttgctcacaaaaagctctacttcacacaccacctgtgcatgagcgtgccacatcaaaatga

SEQ ID NO: 1339 - DNA, 94 bp, Artificial Sequence
  Affymetrix ID 3800039
cataatcaggtcctctgcaagtgggagtccaactgtgacgcagcccccccacgttcaaagcatcccttcagcttccggcaatctcctctccagg

SEQ ID NO: 1340 - DNA, 25 bp, Artificial Sequence
  Affymetrix ID 3887175
gccctggttgcaactctgctggtct

SEQ ID NO: 1341 - DNA, 170 bp, Artificial Sequence
  Affymetrix ID 4011861
atgaggggaacggtagctgacaatagcagaggagggttttgcagggtctttaggagtaaaggatgagacagtaagtaatgagagattacccaagagggtttggtgatggaaggaagccacaggcacagagaacacagaatcactttatttcatatgggacaactgggaga

SEQ ID NO: 1342 - DNA, 234 bp, Artificial Sequence
  Affymetrix ID 2320367
ggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccaccc

SEQ ID NO: 1343 - DNA, 40 bp, Artificial Sequence
  Affymetrix ID 2680360
gagctgggtcagttgctccattatgtactttggtttgcag

SEQ ID NO: 1344 - DNA, 72 bp, Artificial Sequence
  Affymetrix ID 2866718
actcgctacctcattcgaaggccgacatggcagtgtgcgctattgggtgaaagccgaattgcacaggccttg

SEQ ID NO: 1345 - DNA, 70 bp, Artificial Sequence
  Affymetrix ID 3251759
gacaaccttcaatgcactggtactttgtaccctgacctctactgtgatgaacactcaacttgggcaagga

SEQ ID NO: 1346 - DNA, 26 bp, Artificial Sequence
  Affymetrix ID 3742688
tgtgttgagttggagcttgctttgaa

SEQ ID NO: 1347 - DNA, 197 bp, Artificial Sequence
  Affymetrix ID 3772092
tggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatcca

SEQ ID NO: 1348 - DNA, 305 bp, Artificial Sequence
  Affymetrix ID 2596545
gacagcagagctatctatcagttcctctgaacttgttctgaatgagcttttcttactgttcagtcttcactctcctattactgttttgcttcctcatagaattccagattagtgggcccctggaagttcagctggtagatgagaaaactgagcccattgaagttaaagtcacccagctagtcagggttgatcttcccaactcagagtcccctgcttacttaaacttttatatccaacaggtttacttcccctggaaacttatttggtattttttattttccatctccatgccctcgataggtttc

SEQ ID NO: 1349 - DNA, 97 bp, Artificial Sequence
  Affymetrix ID 2928626
cagccgccaaagacgcctgagagcggcaggggagtgtgttgccttaggacaatagcaaactgggacgtggtagagtctgtaaattccaagcactggg

SEQ ID NO: 1350 - DNA, 25 bp, Artificial Sequence
  Affymetrix ID 4035053
catggtatcatgtgcctgtaatgtc

SEQ ID NO: 1351 - DNA, 25 bp, Artificial Sequence
  Affymetrix ID 2487210
cagggtcaagaacaaccagccagcc

SEQ ID NO: 1352 - DNA, 25 bp, Artificial Sequence
  Affymetrix ID 2891955
ggcccttgacaaatgcctgaaatct

SEQ ID NO: 1353 - DNA, 25 bp, Artificial Sequence
  Affymetrix ID 3061185
ctcttcaaacaacaaccaggaggaa

SEQ ID NO: 1354 - DNA, 81 bp, Artificial Sequence
  Affymetrix ID 3104349
atggacaagttaggccctccacttcgaacgggaagacttgtgcaaaggttgtatgacagtgatacaaaatcagacagtgcc

SEQ ID NO: 1355 - DNA, 158 bp, Artificial Sequence
  Affymetrix ID 3915245
aattgggttcttgaggtggattggaggagaacagcctctggatgtctgctgggcagtgacgatgtgtctggaggctttgacattggattcattaggcattgctaatgtacacaaaaaatgtagcaaaaatgatgcctgtttctgggtgagaacatctg

SEQ ID NO: 1356 - DNA, 178 bp, Artificial Sequence
  Affymetrix ID 3961553
ctcccaggtttacaggtcttgactcagtacttcatcagcaataggttgtggtcacaggaaatggaagctgcctcaggacctgtagcaacttgcctgcatgctgggttatgttatcttttgagtggtgcccaatacgaggtgtctaggggaaagtcttaagtggttggagcccatgaca

SEQ ID NO: 1357 - DNA, 27 bp, Artificial Sequence
  Affymetrix ID 2523501
tctcacagtggaattcgtccctttctt

SEQ ID NO: 1358 - DNA, 47 bp, Artificial Sequence
  Affymetrix ID 3601127
gtgtgtttgtgcaagcatgttaagcatttctctgtcttgtgttcatt

SEQ ID NO: 1359 - DNA, 49 bp, Artificial Sequence
  Affymetrix ID 3892321
tgcaggggtgtccagacggcctggtgcaggatccctttgatgtggagga

SEQ ID NO: 1360 - DNA, 91 bp, Artificial Sequence
  Affymetrix ID 3087823
ggaggatgttcggactatagattcagctgtgggatctggttctgtagctgagagcacatcgctaaacatagatgtgcagtctgaggcttca

SEQ ID NO: 1361 - DNA, 99 bp, Artificial Sequence
  Affymetrix ID 3337295
aaggctacaactgtgctcttagaggcaaaagaagaaaatgagactgccaggcatgaataatgagaaatctttgatggaattagccatgcagaacagata

SEQ ID NO: 1362 - DNA, 36 bp, Artificial Sequence
  Affymetrix ID 3528558
tctttggtcccggaaccagattgtccgtgctgccct

SEQ ID NO: 1363 - DNA, 576 bp, Artificial Sequence
  Affymetrix ID 3536444
cttttctctgtagttggcggaatcagctcagttacattttttactaagttacccacattctgacactccttgacagttttaagatcttcttctaacacacttgaatagaatggatactggaatctattttgacagctgttgaaaatctattctgttgttacaggaggttaaggaggttatttgtaacactgggattatttaatgaaccttttgaaaaggtgtgcagactgttcaggcaaatagtattttttagaatttaaatgattttggttttcacagttaaattatcaaatgtaatgcttttaagaattatacacctagtaatatttttcattaattttctccaccagtgtagtaatagtacattacaatgttctcaattaccggtgccttctaaaatgcaggtgtagagtctttaaatacagctagtctattgccagctgtcccatagataaccttctctttaaaagtgacctttgagcaatttcataaagaataaatatttctagttttttgttgctgaactgctaaaagatggttctatacatgtaacaggtggctttagttgggttgctt

SEQ ID NO: 1364 - DNA, 36 bp, Artificial Sequence
  Affymetrix ID 3823557
atggcgaagacctacgattacctgttcaagctgctg

SEQ ID NO: 1365 - DNA, 117 bp, Artificial Sequence
  Affymetrix ID 2707806
cagacccttgtggtcgagttgtttactttggtaattaagtacctgactctgctggacgctcttcgcgtttcagaagcgctgtttggcattgtacagtctgagcgtgagttgaattcc

SEQ ID NO: 1366 - DNA, 93 bp, Artificial Sequence
  Affymetrix ID 2849541
gttcttcataaatcctccactcacaagcttgcagcctttcctatcacagtcatatccaatctcaattcccctgcccagtataatgggactcga

SEQ ID NO: 1367 - DNA, 299 bp, Artificial Sequence
  Affymetrix ID 3795889
acgctgaccagtgaccgaggacacagttgtgtgttaggctccatcacctgctgtactttgagttgggaaattttcatcatcttagaaactgggtcattttatcagagtctagagtcagatatagaaaaagtttgtggctatttctccaatttatatgactaaggtcgggtatctttttcaaagtgtctaattgaaattgaaaaggcagcaatttaaagttgctattgcaagggcagaaaatggtcttaagaaagccagctttcaaattgaataaacatgactgcgttcactttttgagc

SEQ ID NO: 1368 - DNA, 58 bp, Artificial Sequence
  Affymetrix ID 3895772
gaaacaaactgacaatactcgtgaaatcaacacccagatgaggtagaccagcactcca

SEQ ID NO: 1369 - DNA, 27 bp, Artificial Sequence
  Affymetrix ID 2920915
ccaactcacaccatagcagcgctcatt

SEQ ID NO: 1370 - DNA, 79 bp, Artificial Sequence
  Affymetrix ID 2971825
ctggaggcagcagtattctggcagaatttggaaccctgcatttggagtttatgcacttgagccacttatcaggaaaccc

SEQ ID NO: 1371 - DNA, 331 bp, Artificial Sequence
  Affymetrix ID 2990655
ggtttcttgataactgctccacttagagaaatgagctgtgatctgtgtagttttggaaaatgggtagctggggggatcatctttaaacaatctttttcatgctcatcacgaaatgcttttacaataggtttattttgactttgtgtttagaatttttttttttttttgctttttgctatagactctttaaaaaagttgttcttctggatattattgatagatggaacaaaattcatgtcccttgcttgaatcttttagcgagctattcagagattctatatccccatttactcatggttttttcaaggtgaatgaaacaacataccctgct

SEQ ID NO: 1372 - DNA, 1067 bp, Artificial Sequence
  Affymetrix ID 3198975
tgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgacttatattaacatcttataatacaatagtttaagactaagggaaacagatggagctgtttattgagacaactggtgaggaattatcatgtgttcattcccattttagagcgtgaaactcc

SEQ ID NO: 1373 - DNA, 27 bp, Artificial Sequence
  Affymetrix ID 3652974
ctgacatggtgtgtcacaaagagctcc

SEQ ID NO: 1374 - DNA, 25 bp, Artificial Sequence
  Affymetrix ID 3680296
gtagaccctacaccattcctcagcc

SEQ ID NO: 1375 - DNA, 27 bp, Artificial Sequence
  Affymetrix ID 2530462
ttccctgggttaatgggtgaagatggc

SEQ ID NO: 1376 - DNA, 106 bp, Artificial Sequence
  Affymetrix ID 2550272
caggggcaagagctagttagaaaactgagctcgccctgtctctaatgtctggtgagctgctctcctctctctacaatatatcacgggtagtttcatgtcaacaaac

SEQ ID NO: 1377 - DNA, 25 bp, Artificial Sequence
  Affymetrix ID 3118585
gaatatgttgttaagtgggcagcat

SEQ ID NO: 1378 - DNA, 83 bp, Artificial Sequence
  Affymetrix ID 3403090
taagtttgctcgcttggtcaagtcctacgaagcccaggatcctgagatcgccagcctgtcaggcaagctgaaggcgctgtttc

SEQ ID NO: 1379 - DNA, 43 bp, Artificial Sequence
  Affymetrix ID 2524930
tgtgaacttgggttgtgtcgtagaaaatgtgagtgtcagagag

SEQ ID NO: 1380 - DNA, 42 bp, Artificial Sequence
  Affymetrix ID 3125787
ggttacgactttggctacttaatcaaaatcctaaccaactct

SEQ ID NO: 1381 - DNA, 32 bp, Artificial Sequence
  Affymetrix ID 3171102
ccaaggactggcaggacgtcagtgatgctggg

SEQ ID NO: 1382 - DNA, 175 bp, Artificial Sequence
  Affymetrix ID 3250113
cctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccg

SEQ ID NO: 1383 - DNA, 800 bp, Artificial Sequence
  Affymetrix ID 3747008
ggtgactggaccacgcaggtagtttctcatgaatgatttagcactgtccccctactgctgtctcgtgatagagttctcatgagatttggttgcataaaaagtgtgtagcacctcccctctctcttttcctcttgctctagccctgtgaagatacctgctctggctttgccttttgccatgagtaaaagctccctgagacctccccagtcatacttcctgtacagcccatggaaccatgagccaattaaaccttttttctttataagttacccagtctcaggcatttctttatagcagtgtgagattgaaccgatacagacaacaataacaaaaagtagataaatatgaaggccagagaaatggcaacttcttcacgaagggaagctgcttatcctcaagcaagtcagttgaggactatcctgtgagctattttccgtgccttgttttccactcatacagggaagtatgccctggtgtctcacagttgcttcagttcttctttactgggaccctaaatataataacacactgaaccactcaacttctcagaccttcaatatccctggggctttttctcaaatggacacagcatagctttcagaaagctgaataatgtagacaaaagaagtctccctcaccctttgattatggaaaaccaaagatttattcagtgccaaggataagaaaggaaggacttgatcaacaaccactgttaagattttgacccattcactacttcacgtgaactcccagggaaatggaaaatgaaagaaggtctccgcggtagagggataacaatg

SEQ ID NO: 1384 - DNA, 280 bp, Artificial Sequence
  Affymetrix ID 2406715
acagagccctgattccacatacatgagctcccatgtgtggctggggctctgctgggtcctgggggcaggaggaggatggagaggcaggccctaccatggaggaggttgtgatctaggggcaggctcctaaccagttaacatgtgcacagtttggcaagtctctcacagaagtctatagcatgtgggggaacccagtggaagaagtgatcgagctctaggatgaggaggagactggggagaacttcagagagcccttagaacttgaactgggactgggcac

SEQ ID NO: 1385 - DNA, 312 bp, Artificial Sequence
  Affymetrix ID 2808962
cctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttccc

SEQ ID NO: 1386 - DNA, 218 bp, Artificial Sequence
  Affymetrix ID 2849483
cctgttggtgtgtcgataatggcaaggtctgcagtgacccagcagtggctgaggtggggctggggctgagaacctgatccctgagaggccatttattgtaagaacaggcaacatggcagggaagtgaccaggaactaggacaggcagtaagtgggagagaatgacggcaagcctggagctgtcccagaggtgactgacggatgctgtacaaggtggaa

SEQ ID NO: 1387 - DNA, 70 bp, Artificial Sequence
  Affymetrix ID 2868168
atttgccctacagatggtgtaaaagggatggatggcttttgctctagaagtcaacattcatcttcatcct

SEQ ID NO: 1388 - DNA, 95 bp, Artificial Sequence
  Affymetrix ID 3082899
atggagttcgagtgaatttgaaagttacgaagagcagagtgactcggagtgcaagaatgggattcccaggtccttcctgcgcagcaaccacaaaa

SEQ ID NO: 1389 - DNA, 40 bp, Artificial Sequence
  Affymetrix ID 3505964
gctgagaacgcatctttagctaaacttcgcattgaacgag

SEQ ID NO: 1390 - DNA, 107 bp, Artificial Sequence
  Affymetrix ID 3522535
caaagctaattgagccactcgactatgaaaatgtcatcgtccagaagaagactcagatcctgaacgactgtttacgggagatgctgctcttcccttacgatgacttt

SEQ ID NO: 1391 - DNA, 1360 bp, Artificial Sequence
  Affymetrix ID 3404455
cactagacagcaattcagagcctccaaaataaagaatattcataaaagtaacaatagaggtaaatataaaacccagaattactacatgtgtcatatagtttataacttctcctatttatagctttctatatttatatttatctataacttcataggcaaatgaataaaaattataaatatgatagtggtcatataatgtataaagatgcaatctgtgacagtcttatgaagcagggatgaagacatataggatcaaaatgtttgcatagttattgaagctatgttgatattatgaaattatattgttacaagtttaagatgctaattataattctcaaggtaaccactaataaaattaccaaaattatgcagaaaaggaaaaaagaaaaacaatacactataaaaaaccaattaaatacaaaaaaagtcagtaacagacaacttgagaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaaacaaaataaactaaagtaaaatttacaagagaaaaagaagggcattatgcattgacaaaaattttgacatagccaaataattatgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaagaatctacccaacaagagcagaatattaattcttctcaaatgcacatggaacattcttaaaccatatgttaggccacaaaacaagtgttagtaagtgtgaaaatttgaagtcataaaaagtatcttttgcaattacaatggaatgaagctagaaatcaataactagaaaaaccagaaaagtcacgcatatgtagaaatttaaaaacccgctcttcaacagccattggtcaaagaagaaatcacaagggacattagaaaataccttgagacaaatgaagtaaaaatacaaatagcacgtttatggtatacactgaaca

SEQ ID NO: 1392 - DNA, 27 bp, Artificial Sequence
  Affymetrix ID 3309338
ttccagctcatcggcgttgaggtgcac

SEQ ID NO: 1393 - DNA, 25 bp, Artificial Sequence
  Affymetrix ID 2475878
gctgctgagtctcaaaacagccaaa

SEQ ID NO: 1394 - DNA, 42 bp, Artificial Sequence
  Affymetrix ID 3032635
gaggctcctcttcctatggatttgcttcaaggaggtcagggc

SEQ ID NO: 1395 - DNA, 93 bp, Artificial Sequence
  Affymetrix ID 3475556
attacattgaggattgtatcgcccaaaagcactcgttgatcaaggtgttaagactagtttgcctccaatccgtgtgtaatagtgggctcaaac

SEQ ID NO: 1396 - DNA, 101 bp, Artificial Sequence
  Affymetrix ID 2930679
gatcaacattcttaatgacataagagaagggagttgcaggtggatctaagggaaaactgttccagtagtaaaggagcagcaaatccgatagccctaaggga

SEQ ID NO: 1397 - DNA, 26 bp, Artificial Sequence
  Affymetrix ID 3489376
ggatcataaaacaggagttggggcag

SEQ ID NO: 1398 - DNA, 31 bp, Artificial Sequence
  Affymetrix ID 3933755
gtttgcatttgaccatgtcgtgggcaggaga

SEQ ID NO: 1399 - DNA, 29 bp, Artificial Sequence
  Affymetrix ID 2430088
tcattcttaaggctaaggtggcaagataa

SEQ ID NO: 1400 - DNA, 107 bp, Artificial Sequence
  Affymetrix ID 3420474
atggaagcatgttggcgtcatcagcagagacagggaaattgggaaggagaggagagcataattagtgtgcagaaacttggaaatgctgacattggactcctggcaga

SEQ ID NO: 1401 - DNA, 75 bp, Artificial Sequence
  Affymetrix ID 3956302
gactgtccccagatgtgtgcctataagctggtgaccatcaaattcaagtggtggggactgcaaagcaaagtagaa

SEQ ID NO: 1402 - DNA, 287 bp, Artificial Sequence
  Affymetrix ID 2334264
ctgctcgctgagatagacacatacctgattgcctcctttggagaggcttgtcagaaacaaaataatgcaaccatttgtctctcagctacctgcgacctggaagccccctccccacttcgagttgtccccgcctttctggacggaaccaacgtacttcttacatatatcgattgatgtctcatgtctccttaaaatgtatgaaaacaaactgtgccctgaccaccttgggcacatgtcgccaggactccctgaggctgtgtcacgggcacgcatcttcaaccttggca

SEQ ID NO: 1403 - DNA, 500 bp, Artificial Sequence
  Affymetrix ID 2358760
cagcctggtgccctattaataagactgtcaaaaagaggtctttgcccttcatgttgtctgcctgcttctccactaccactcaaagtcctttcccccttcaaatcacataaggactgcaggtaggcactagggggacctggccacatctggaaacagggctgtggctaagttccctgtgaaagtagaagagtcaaaaggcattggcagggttatggggaacaccaagggagggaacacccccacctcctcctagtaacctgaacctccctgcctgctgatccccagagtataaataatcccctggtgaactggcagtaacccttgggggttagcgccaagattctcaccccaaagcccaaggaaggaggcaggcaaaatggatagaagggcttttatttacaggaaaggaggacagatgaggatttaagtgtccagtgctcccagcgctagttggtaaagggaaatgcagtgttatctcttcttttgctggcgacctgtaa

SEQ ID NO: 1404 - DNA, 30 bp, Artificial Sequence
  Affymetrix ID 4005886
tcatcacaaagcacccagaccggtttgcgt

SEQ ID NO: 1405 - DNA, 31 bp, Artificial Sequence
  Affymetrix ID 2440191
ctcctcacccgcatcataactcctcttcaag

SEQ ID NO: 1406 - DNA, 96 bp, Artificial Sequence
  Affymetrix ID 2561968
aactgtggaatggatcacgtagacatgtaacccagcagcagtttgcttctgttgtccactgattaatcagcctatgtgcctgacactggtcttgca

SEQ ID NO: 1407 - DNA, 46 bp, Artificial Sequence
  Affymetrix ID 3216427
atgttgagaaagcatatgcatgtgacagggcggatttgttagaagc

SEQ ID NO: 1408 - DNA, 33 bp, Artificial Sequence
  Affymetrix ID 3235909
gttagactcggggttgatatctgtcatcgctgt

SEQ ID NO: 1409 - DNA, 136 bp, Artificial Sequence
  Affymetrix ID 3469137
agcaacagaaagctcgtggtgttcctctgcctcaaaggccaaacgtctgtgggttttttgtcttggctgccgaccgcagcacgtcacactgtttgaaatttgcagctgcgatcatttatcttcaggggacaggggt

SEQ ID NO: 1410 - DNA, 25 bp, Artificial Sequence
  Affymetrix ID 2343471
gacagattgaaagaggtggtgaagc

SEQ ID NO: 1411 - DNA, 115 bp, Artificial Sequence
  Affymetrix ID 2464386
ggtacacacattaggagactgcagttttggtgagaggtgatggaagctcgagactagtgaggaaaagggaggtgtcaacatgagccctagattcttggagtccagaacttgaaga

SEQ ID NO: 1412 - DNA, 30 bp, Artificial Sequence
  Affymetrix ID 2672266
gtgtgagcatgcacaggttagggtgggctg

SEQ ID NO: 1413 - DNA, 310 bp, Artificial Sequence
  Affymetrix ID 3730349
tgggcctttcaaattgagtctaagtttaaaagatataaagaggtgtgggggaagggcattcctggcagagggaagagcatatgcaaaggtgtggaggcctagaactacactgcagctttaaggggtggtgagtgatggccgggcaccgtggctcacacctataatcccagcactttgggaggccaaggcaggaggattgcttgagctcagtagttcaagaccagcctgggcaacatagcgagaccctgtctctgcaaaatatttttaaaaaattagctgagtgtggtgatgcacgcctgtctactaggga

SEQ ID NO: 1414 - DNA, 78 bp, Artificial Sequence
  Affymetrix ID 3755723
ggctcctccatagcagagaaatcttatcagaatagtcccagctcagacgatggtatccgaccacttccagaatacagc

SEQ ID NO: 1415 - DNA, 240 bp, Artificial Sequence
  Affymetrix ID 3861643
ctggcaagcagacgggtttggaatagacattggaagaagcttttagggcatcctagacagcgttgcgatgcttggggcaggggcaggaaaaagccactgatggactttcagggcagagctgtaatcgagttgatgtttcagatttagtcgaagggtgtgagagggctgagacggagaaagtggtgtggcagaagaggttgctggtggccatgggtcggggtgcagattatgagagaactc

SEQ ID NO: 1416 - DNA, 62 bp, Artificial Sequence
  Affymetrix ID 3542787
tttgatcctatgtgggagcgactgaaaatagaatgagcttggttaagcacctctcctttgcc

SEQ ID NO: 1417 - DNA, 25 bp, Artificial Sequence
  Affymetrix ID 2468417
tgccaccaaaggcatggctgtgggc

SEQ ID NO: 1418 - DNA, 155 bp, Artificial Sequence
  Affymetrix ID 2520238
gggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatctt

SEQ ID NO: 1419 - DNA, 288 bp, Artificial Sequence
  Affymetrix ID 3129693
cagcctgtgtgtactcatttccttctcttgagtaccactaatttgatagttcacgtatcctctactaagaggtagagtgagacagcttagggacatcagaagtactactttcggttcttccacatggaaacatgaggaacgaggaataagtattctttccctaacacttacagtgcacttaagacaaagttttttttttttttggactgaatatacgtcgatggacacaggcccagatatggagaaagggcaggtttcctctaggcaagatttgcacggggaacctga

SEQ ID NO: 1420 - DNA, 397 bp, Artificial Sequence
  Affymetrix ID 3845840
cctggatccctgaagactgctctgagatcgatcagccagagagaaacagagagaaagctggctcagccctgaaggctttgagcaaaagtttcagaaggagctggaaggagacaacagcccgttctccctgagctgtggccgggagggcccaggccagcaccacgatgtacagatggcccagggggctcgacatgagtgagggctgaagttcgtgcaaccccaaccgccacccctgaattgggcagaaccaatttttttcttagcacctgtctgactctgcttaccatgacaaccccaagggccccccagaattgatatccaagtgcctttagcctatcaaagacaggagggggtgcattctcggccaggttagggttcacagagcatccgtatatta

SEQ ID NO: 1421 - DNA, 90 bp, Artificial Sequence
  Affymetrix ID 2621185
ggctgtagacctggaccatgtgacagatgagcgggaacggaaggctctggagggcattatcagcaactttgggcagactccctgtcagct

SEQ ID NO: 1422 - DNA, 341 bp, Artificial Sequence
  Affymetrix ID 2871234
tttgctgccatccatagtcttttcctaagtatcacaaaaggatatgcctgccaatctcttaaaaaatgacaatgcagacttgtgctcaaaatgaagctacagatttagaacctcagattcaatgaactaaaaggagaatatattaaatgttaaatttgacctcagaaattccactatactaaggatgttgcctaagacctctcaaagactgaggaccagcagaacactgcccatttcactctagaaccacacacaagtctgttgttcccaagccaatgtgaaagctataagccttgagactcaaaagagcacaggtgtccacaggtgacccaaacatcaaa

SEQ ID NO: 1423 - DNA, 26 bp, Artificial Sequence
  Affymetrix ID 2904825
ccaggggctcactttctccaacaaaa

SEQ ID NO: 1424 - DNA, 29 bp, Artificial Sequence
  Affymetrix ID 3133366
gtgtcagtacagccgcgtggcagagctga

SEQ ID NO: 1425 - DNA, 572 bp, Artificial Sequence
  Affymetrix ID 2577848
ggcttgcatcagcacacattgtacagccttgcaaattacacagaaattgaaaagaaggttccttgttcataagtgcaatgaatctttgatgtccagtgatccgctgcaaacaatgaaaacaaactgtaaagcacttaagaagtttccagcactcatcaaatgcatttccttaggtgacaaaaaatccacaaggagaatgcaaataagtggcatttagttattagagagatacttgaaaaaaaaaaagtggaagtattttcctgcttagaatgatttctgttcccctttgaatgtaagtggtttaagaggcattaagaacataatttattttatacttaatgttcacactacctaaatgaataaggaaagggccctacaaggaagagttatgtattttttggtaattgtttctgagtttagagattcaggggaagagtaatcctctatttgtgggctcttcttagcatccctaacccccaaggagatagtacatggttttgacttggttatttcactcctgcattctttttcccccaaattttaagttgggtcacattgtgctggctgcaaaa

SEQ ID NO: 1426 - DNA, 133 bp, Artificial Sequence
  Affymetrix ID 3332349
ggggatgtctgcaatgtcagcactgattgcagcaccaaactcaaagacaataccactcatgccactgccaacatacccctggcttcctcaacaactttagaattattatattgccctaagtgcatctagaata

SEQ ID NO: 1427 - DNA, 88 bp, Artificial Sequence
  Affymetrix ID 2416733
ggaaaagtacatgccagaagtcagctgtgcagtaacctatgagagagctactcctgtttcaccccagatcatcacctcgattccaaag

SEQ ID NO: 1428 - DNA, 97 bp, Artificial Sequence
  Affymetrix ID 2437457
aagcaccagttgagattcccagtccttctgaaaccccagctaaaccttctgaacctgaaagtaccttgcagcctgtgctttctctcatcccaaggga

SEQ ID NO: 1429 - DNA, 49 bp, Artificial Sequence
  Affymetrix ID 2704212
gagattgatgtggttgtcagctaaacctgctctttcagtagtggaaatt

SEQ ID NO: 1430 - DNA, 60 bp, Artificial Sequence
  Affymetrix ID 3888795
gttgtttgccttgacagtgcggctgcgcttcggcctgctcgggttaccagggaacaaggc

SEQ ID NO: 1431 - DNA, 219 bp, Artificial Sequence
  Affymetrix ID 2556326
ttgcctcagctgactttaccaaaaattccctttcccttccctgctttaagtcatttcatgtaggttagtcttcatttattcttttgcctctctacagtagttattgctttgtgctgtacatttgggttaaaggagttgtatatgtgtatggtgacagcataatgcctctgaagcccaggacctagctacttcttagctcctaacgtaatttcatccatg

SEQ ID NO: 1432 - DNA, 40 bp, Artificial Sequence
  Affymetrix ID 2878702
gtcagagtgtataaggtgaaatgccgttctgtttttggag

SEQ ID NO: 1433 - DNA, 175 bp, Artificial Sequence
  Affymetrix ID 3328538
gccatccggatgtcagctctgtggacattgactgctggttttcctggggcctcggttttcctctctggcctggcatggactgcctcttgccttggagttgctgggatggtggggtgtgtgtgtgagtgagagtgtgttgttggggggcagtgccctggagaggacttcatagcct

SEQ ID NO: 1434 - DNA, 30 bp, Artificial Sequence
  Affymetrix ID 3496801
aggactgtgtggcggactatgcagcatagt

SEQ ID NO: 1435 - DNA, 31 bp, Artificial Sequence
  Affymetrix ID 3668198
tccacagggcagaaactattgcagagttcac

SEQ ID NO: 1436 - DNA, 78 bp, Artificial Sequence
  Affymetrix ID 3764547
agcagtatttccgagacgagagtggcctgaaccgaaagaacatccaagacaacagggtgcactgctgcctgtacttca

SEQ ID NO: 1437 - DNA, 32 bp, Artificial Sequence
  Affymetrix ID 2544277
ggagtgctagcaagtctggagcatcaaataaa

SEQ ID NO: 1438 - DNA, 26 bp, Artificial Sequence
  Affymetrix ID 2581567
agcagtttggcagccacatggattga

SEQ ID NO: 1439 - DNA, 25 bp, Artificial Sequence
  Affymetrix ID 2612556
gcctgggggaatccgtgaacgccta

SEQ ID NO: 1440 - DNA, 30 bp, Artificial Sequence
  Affymetrix ID 2894809
ggtgtattcatttccgtgtattgctgcttt

SEQ ID NO: 1441 - DNA, 26 bp, Artificial Sequence
  Affymetrix ID 3956007
gacagtcttcagaaaagggcagctgg

SEQ ID NO: 1442 - DNA, 140 bp, Artificial Sequence
  Affymetrix ID 2407214
gaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcat

SEQ ID NO: 1443 - DNA, 105 bp, Artificial Sequence
  Affymetrix ID 2948537
tctttctcacatcctagagacggtctttaatacgcattaaccctgtgctgccacatctggctcctgccctcattgcctccaatccggactcttcctctcacatca

SEQ ID NO: 1444 - DNA, 37 bp, Artificial Sequence
  Affymetrix ID 3991159
acaggtggactgcagggtcgtcttacaaaatgacaag

SEQ ID NO: 1445 - DNA, 75 bp, Artificial Sequence
  Affymetrix ID 2444356
tagaccctgacattcagctccaataatggatgtcccagtatgccctgaatccaaacaaatgcctgactgcaataa

SEQ ID NO: 1446 - DNA, 36 bp, Artificial Sequence
  Affymetrix ID 2480997
agacaggttggagttgggtatgtggattccatacag

SEQ ID NO: 1447 - DNA, 194 bp, Artificial Sequence
  Affymetrix ID 2671526
atgttccttccaaatctcacattgaaatgtaatcttctatgttggaggtgggcctgttgggaggtgactggatcgtgggggtagatttctcatgaatggcttatcgtcatcctcttggttctgtccttgtgatagtgagttctcgtgagatcatgttgtttaaaagtgtgtggtatccctctgccttgctcttg

SEQ ID NO: 1448 - DNA, 161 bp, Artificial Sequence
  Affymetrix ID 2673140
aagaccacattgagccacctatctccatctgtgcttatgtactctgcttccttcttgttaggatgaacaatgggcgaaccttccaagttcctatttaaagttaccccaatctgtgcagaagatcctgtctcctcccacctactcaaggcattactctggca

SEQ ID NO: 1449 - DNA, 55 bp, Artificial Sequence
  Affymetrix ID 3394422
catgaaggtcctctacttatccgccttcactagcaaggacgagggcacctacacg

SEQ ID NO: 1450 - DNA, 39 bp, Artificial Sequence
  Affymetrix ID 2485881
ggggtgacattcagattcaatcggtctacggatgagaaa

SEQ ID NO: 1451 - DNA, 624 bp, Artificial Sequence
  Affymetrix ID 2572007
aggcttctttgacaatcgtttctgatctttagctgagtctagatggtaaaagtgaactagtgaaagggaagaatgagttttgttttggatggcatctcattattttttattttctttttatttatatatttgtttttcttatttttttttctttttgattttaatacctccaccctacttacagatattttttattttcttgacaactctgataaatgatggattggaggatcagacttgttgacatcactgatgaggcttgtcttgttgcttgtcttctctggctaacattccttagtaaaaatatttctatatttttttctttattttatttggtcattatttcattttgagcttttttcatttattactagataagcgagttttgagtgtcaaatttgcacttaatttgtttttggtactgtcataaggactgtagcatacacagcatactacaactgtaactttttacgaaaatatacattttttgaagatgacttcagaaactgagggagagagacccacttgagactaggcagcaaacagtgaagaagaaatgagcaacatggtgtgcaggagcaaagtttcctactgtatatctctactctaagtgtacaatgccta

SEQ ID NO: 1452 - DNA, 111 bp, Artificial Sequence
  Affymetrix ID 2804366
gatacttcatctagtaattcctgcccaggttttgaaacctcatgctggaccctcctgtgcaaggctgccctgctcattctgctctcatctgatcctctcactgggccagtc

SEQ ID NO: 1453 - DNA, 174 bp, Artificial Sequence
  Affymetrix ID 2369480
tcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaaca

SEQ ID NO: 1454 - DNA, 337 bp, Artificial Sequence
  Affymetrix ID 2556336
agtcctgtctagtggtcagtcctaacagtgtggttaaaggggagctaaatttcaactttcaggggtcagctgagacaaccacctagattttccaagttagttccaatttcaagtacaataatcctttgacaacatagaaaagaattatagttagcaaaattgcaattgtcacagtcaaggtcttgttggtaatagagggttggggaaaaagttaaaacagcattaaatgaatatatttttaacataacaaaagttcccagaagacatccacttcaaattcaagccatattcatcaatgttaaaaaccttactcttctccctgatagtgtgaggaaaa

SEQ ID NO: 1455 - DNA, 28 bp, Artificial Sequence
  Affymetrix ID 2589618
cctatccctgtaaagcctgtcccagaag

SEQ ID NO: 1456 - DNA, 631 bp, Artificial Sequence
  Affymetrix ID 3405368
ctggggcataaaaaagcaagtgttctcactgagggatgaatagtctactagcaactgtaagacagttgcacgaataatgatgatacaaagaggtatccgatgaatataatgtagcaggataaacaaaatggcagtggaaaacaggagtaaaaccaaagggaaggattctgagaagactatttataatgggaactaaaattgtcagctgaagctcagatggcggtagaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttg

SEQ ID NO: 1457 - DNA, 25 bp, Artificial Sequence
  Affymetrix ID 3447472
ttttaaggagggttgcagaaagtga

SEQ ID NO: 1458 - DNA, 27 bp, Artificial Sequence
  Affymetrix ID 2331932
tgccggtgcagttccttggtatactga

SEQ ID NO: 1459 - DNA, 72 bp, Artificial Sequence
  Affymetrix ID 2413973
tacgtcgatggagttcagcacaagcacgagaatttgggaatcttcacaatacagtggcgttacttgttttgc

SEQ ID NO: 1460 - DNA, 25 bp, Artificial Sequence
  Affymetrix ID 2972147
aagtcaggagggttcagtgaccaga

SEQ ID NO: 1461 - DNA, 94 bp, Artificial Sequence
  Affymetrix ID 3568132
ttaggtatttcgagtttgaagtgtctataagtcatctggagctgtccaggagatggttctatacatgaagatcaggaccagtttcttgtcatca

SEQ ID NO: 1462 - DNA, 410 bp, Artificial Sequence
  Affymetrix ID 3593984
ccaggtggtctagcgctcctaacaaacaccttatgattatccttcattcaacagaggaggagactgcaggcatgcttcagtcagtggtaagaacaggaagaaaaacccaaatcagcaacattttcttccttaatttggtataaacgtccttttcattatttcaagttactaatttgctaatctcaaatgttttctgaatcaggtttgctaaatgctgtaaagaatagctatccttcatacaatactaggttttattttttttagtatgtcagcataataaggtacatgcgcattcattccaccaacctgtttagataatactcagcttgggtcatattcaaattctacacagagattctctgttttcaatacaactgcttagaaagcagaattgcctagtgatgactgta

SEQ ID NO: 1463 - DNA, 399 bp, Artificial Sequence
  Affymetrix ID 3878647
gcagcccatcccgaagtgcttattacattagaacatttagtgcttttaaagatggtgtgtgtgtgtgtgtgtgtgtgtgtgcgtgcgtgtgtgtgtgtgtgagagagagagaaagcatatctaaatgttggtaccaaatcataccccattggaaagattcaattttctgaaattccacctaagaatttttgtatgtatatatgaaggcaattgtgaaattatagagaattagcaaagtttatttagaatttgaggggtttggagtgcagttttacagattttctgactctcttttctttaatgtccatgcagagactaacataattgacttttagatctttatccagagagtcaatccaattcaattcaaaaatgtttattgccagtccactctgaaca

SEQ ID NO: 1464 - DNA, 25 bp, Artificial Sequence
  Affymetrix ID 3271123
gtgagtccctgggtcagtgagcaca

SEQ ID NO: 1465 - DNA, 94 bp, Artificial Sequence
  Affymetrix ID 3291284
gaaagtggcttatttgaggttgttggtgctgttggtattattgccatagttgttatttaattgcttgattaaactcagtcaaatatccttccta

SEQ ID NO: 1466 - DNA, 104 bp, Artificial Sequence
  Affymetrix ID 3859781
caaggagccaccagattggatgggagcccccacactccctccttaaaacaccaccctctcatcactaatctcagcccttgcccttgaaataaaccttagctgcc

SEQ ID NO: 1467 - DNA, 30 bp, Artificial Sequence
  Affymetrix ID 2326309
ccttcacggatttggttggggtcagagaga

SEQ ID NO: 1468 - DNA, 241 bp, Artificial Sequence
  Affymetrix ID 3091040
agtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctac

SEQ ID NO: 1469 - DNA, 146 bp, Artificial Sequence
  Affymetrix ID 3823592
ggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgtta

SEQ ID NO: 1470 - DNA, 65 bp, Artificial Sequence
  Affymetrix ID 3551323
ctacaccacaagtgccgcaagtacagcagtcacagccgtctcaaagctccgaaccatcccagccc

SEQ ID NO: 1471 - DNA, 25 bp, Artificial Sequence
  Affymetrix ID 3602745
atggatttgttagtttggaagaatt

SEQ ID NO: 1472 - DNA, 82 bp, Artificial Sequence
  Affymetrix ID 2332284
cccggcgcgtatcgtaggcagtgtaccgtggccgtgccgtcagagtgtgcgtgtgcgtgtgtgccgtgtcgaggctgtgtag

SEQ ID NO: 1473 - DNA, 122 bp, Artificial Sequence
  Affymetrix ID 2689891
ctagaactatattagctgctcagtgagttgggcaattggatatttttggttttatgatttcagattttatagaccagtggaatacaggccttgtgcatatgaagatcaggtgacaagtttgc

SEQ ID NO: 1474 - DNA, 28 bp, Artificial Sequence
  Affymetrix ID 2952713
tgtttgttgtttggttatgatcttgctt

SEQ ID NO: 1475 - DNA, 370 bp, Artificial Sequence
  Affymetrix ID 3181289
cggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttc

SEQ ID NO: 1476 - DNA, 106 bp, Artificial Sequence
  Affymetrix ID 3412443
acctttgacatctctagcacacggagcaattctagatggttgataaaagagcataaatcaatcgacacaaatatccccttaaaccttgtctttcatgtccagtatt

SEQ ID NO: 1477 - DNA, 39 bp, Artificial Sequence
  Affymetrix ID 3886313
atgagtgacggaaacccagagctcctgtcaaccagccag

SEQ ID NO: 1478 - DNA, 591 bp, Artificial Sequence
  Affymetrix ID 3976557
atgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttc

SEQ ID NO: 1479 - DNA, 117 bp, Artificial Sequence
  Affymetrix ID 2635686
ttccatagctgtagctggagcggtaattggagctgttcttgcccttttcatcattgctatctttgtgactgtgctgctgactcctcgaaaaaaaagaccatcctatcttgacaaagt

SEQ ID NO: 1480 - DNA, 28 bp, Artificial Sequence
  Affymetrix ID 2680971
agttggcttacaacctgtgctgtattga

SEQ ID NO: 1481 - DNA, 75 bp, Artificial Sequence
  Affymetrix ID 2715956
ttgagttgtacagccgctggatcctgccgtccagctcagccaggaggaccccggccatcctgatcagtgaggtgg

SEQ ID NO: 1482 - DNA, 32 bp, Artificial Sequence
  Affymetrix ID 2452913
ctgtgcacaggactcctcaaatattttccgtt

SEQ ID NO: 1483 - DNA, 110 bp, Artificial Sequence
  Affymetrix ID 2667796
caagagaaggtgagcatataacaggtaaataacagaagctctgattttttttttctttttatagtttgggactattcatccagcaagagaaggacgcttaaaagtagatt

SEQ ID NO: 1484 - DNA, 53 bp, Artificial Sequence
  Affymetrix ID 3602153
aagggattctgatgagccgatgggccctggaggcagcccattaaagcatctgg

SEQ ID NO: 1485 - DNA, 33 bp, Artificial Sequence
  Affymetrix ID 3752031
taccaaaaaggcctcgcacattcagttggacag

SEQ ID NO: 1486 - DNA, 127 bp, Artificial Sequence
  Affymetrix ID 3765307
ggaaactgaacagaggctgcttcaagaagctcatgatttgcacctgtcttcactccaactagctaaaaaagcttttggggaatttaatgtacagactgcaaaacactatggaaaccttggaagactt

SEQ ID NO: 1487 - DNA, 25 bp, Artificial Sequence
  Affymetrix ID 3956644
gtacatgcaaacgggatgggagcag

SEQ ID NO: 1488 - DNA, 433 bp, Artificial Sequence
  Affymetrix ID 2345202
tgatgcccgcgttgtcttttcagactctgttttttgcctttagcatgccttgtaatttttttttttttttttgataagctggatgtgacataaggggtaaaaagaactgagataaacaggcctttagtgtggcctagaggcctatctggctaggagttaggctgtgtttactgtttgatgtagctttggtgtcagagattaaaatttcctctcgtgtaactgcttttgtctcctttgttgtctttgggtttccctaataactccttcataagtaggttccgaggcttgtagttatttaagctgtaagtccctgttattacacaggagccctattgatgtggtgtgtgtgtgtgtaaaagtgttctataatcttatgattagctcttagtgagcctgtgtctttggactgtgaccttcatgagtgctttttagc

SEQ ID NO: 1489 - DNA, 36 bp, Artificial Sequence
  Affymetrix ID 2655521
aaaggagagtcggttggaatcatctggcaagaacaa

SEQ ID NO: 1490 - DNA, 69 bp, Artificial Sequence
  Affymetrix ID 2920283
gcaggacatacgctaaaaccggagcaatacagagaagattagcatggccctcacccaaagatgacacgc

SEQ ID NO: 1491 - DNA, 76 bp, Artificial Sequence
  Affymetrix ID 3102056
agattacaaactcacatttaatgttataaatgcagaaaaaggccaaaaacacaaaaagagtggcaacgagggacag

SEQ ID NO: 1492 - DNA, 204 bp, Artificial Sequence
  Affymetrix ID 3161310
tgaagaccttcacgctttctctgtaagttttcattcaaaacatctttcaatttcttttttttctttttcttcttttttgccctcattttagttagtttgagtttcttgtggctctgtagtgactgctctaatagaatatcccttacaactttgtggcagttaatttctggatgatcactgtgacttccatttacatgtatttgg

SEQ ID NO: 1493 - DNA, 86 bp, Artificial Sequence
  Affymetrix ID 3289083
acaggtaaattaggacggcactgcgggtactctgtgttccgcctgctcaagttctagacttctggtgtccatagcaacccagcaga

SEQ ID NO: 1494 - DNA, 25 bp, Artificial Sequence
  Affymetrix ID 3304760
cggggaggaaagacagctctaccag

SEQ ID NO: 1495 - DNA, 25 bp, Artificial Sequence
  Affymetrix ID 3895434
tctttcctgggcacttatctaacag

SEQ ID NO: 1496 - DNA, 224 bp, Artificial Sequence
  Affymetrix ID 3406522
tggttttgtggataggggaaatctagtagatattaaatatttttatctgcaaaaagcatttggtaaggttctcaatgggagattaatgactaaaataaagaatgaggcattaggagataaatttgcttatgagcaagagacagatactaacagtagaaggaaatactttttagattggaaaggagtgacatatagcacaagccaggaatcagttttgggaccta

SEQ ID NO: 1497 - DNA, 56 bp, Artificial Sequence
  Affymetrix ID 2692051
gtatcggattaagctcaaaacgggaggaggaaacaaggatgactggagtcaaggaa

SEQ ID NO: 1498 - DNA, 49 bp, Artificial Sequence
  Affymetrix ID 2835105
ggcaggggttgggacaagtgctaagtatgcaagactcaagggaagagct

SEQ ID NO: 1499 - DNA, 46 bp, Artificial Sequence
  Affymetrix ID 3935012
cttctccaggccagatttaaccacataaacacatcaaatcccagct

SEQ ID NO: 1500 - DNA, 108 bp, Artificial Sequence
  Affymetrix ID 4038282
tggctgggtgagttctaaaaatgcccaagacctccaagactaggtgagatctgaagtaatgaaatgcctccattcactaaaggcctgaaattgtcctgactgcctcag

SEQ ID NO: 1501 - DNA, 30 bp, Artificial Sequence
  Affymetrix ID 2856770
atgttcaaccagatgatgggccatgattgt

SEQ ID NO: 1502 - DNA, 460 bp, Artificial Sequence
  Affymetrix ID 3579731
cccatgtgtatgctttgagccgttccttagttgagtaggtgattgaccataccagcagcactggtgccaattaagcggtctgcttggttcacacagcctttcattcctgttctagcatggctctgtcttaaatctgcatgcatgtatttattccttaatatattacctctcttcctttcttcctttttacatttcttcccattttttattgtttctctctctctcactctctcactcattctctcttgcactttgtcttcggagctcattgccatggagtggcttggctgtacgcatcaaaaagccacccgcaaacgtccatccttggccgtgcggttccacgtctcactcattacttccttcctgcattcatagcatccttccttcctgcttgctctctttttattaggcatttattcctctattagtggagtcaggtgcccttatgacaagtcctagc

SEQ ID NO: 1503 - DNA, 406 bp, Artificial Sequence
  Affymetrix ID 3636549
ctactgaaagcatgtcctgtgaatgttacttgtcagtgacaaaataggtacagaaattgaaataagagtttagaaatttttagagccgtttgatggagtagctttgtgaatctaataattgaggcttacattttgtatgtctttatttttctcataatttatttttattttataaacatgtctgtttgcaactcattagaactttaaaaaaaaaaactagtcattcactctaggtagagtagaagtactgactatgaaggatctttaaaggtcaatagtggtcctaatacgtaaaataatttgctcatatggtgtatttaaactattggcaactatgtaaaagggggaatgggttgaccttcatgttacaaatattaatttctcctgcataaaagtaccctcattg

SEQ ID NO: 1504 - DNA, 209 bp, Artificial Sequence
  Affymetrix ID 3653150
tttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgcca

SEQ ID NO: 1505 - DNA, 285 bp, Artificial Sequence
  Affymetrix ID 4011856
cagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtt

SEQ ID NO: 1506 - DNA, 26 bp, Artificial Sequence
  Affymetrix ID 2351151
aaatagctgggtctcagtgtctcttt

SEQ ID NO: 1507 - DNA, 97 bp, Artificial Sequence
  Affymetrix ID 2577491
gttctccctagttttctctacaacagtggaaaacaaagcagtgctctctatgccaggacagtacatttggacggcgacaccttgtttgcagaatcct

SEQ ID NO: 1508 - DNA, 25 bp, Artificial Sequence
  Affymetrix ID 2693258
atctacattttcacactgacaccca

SEQ ID NO: 1509 - DNA, 249 bp, Artificial Sequence
  Affymetrix ID 3156385
agtcacacccttggggatctcattgtgtttcatgacttaattatgctgctgactctcagattgttatcttagtttttcagacttctttcttgaactccagacccgtggccactatgttctcgccatgtggaatctgatgtctcataagcatttcagacttaatatactcaaaaggaactgatattcacgccaagcctgcttctctccccttctccactcactaaatggcactactttccttctggctgg

SEQ ID NO: 1510 - DNA, 121 bp, Artificial Sequence
  Affymetrix ID 3175668
cttggaggtattatagcagaagtgaatttggccgagcattctacagttattacatttttagattatcatgatggagcagctacattcctcttaataaatcacacaaagaatgaacttgttc

SEQ ID NO: 1511 - DNA, 156 bp, Artificial Sequence
  Affymetrix ID 2389740
atgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagat

SEQ ID NO: 1512 - DNA, 435 bp, Artificial Sequence
  Affymetrix ID 3224499
atctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaa

SEQ ID NO: 1513 - DNA, 931 bp, Artificial Sequence
  Affymetrix ID 2807754
gggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaa

SEQ ID NO: 1514 - DNA, 164 bp, Artificial Sequence
  Affymetrix ID 3929304
tccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacacc

SEQ ID NO: 1515 - DNA, 25 bp, Artificial Sequence
  Affymetrix ID 3947636
gtacggctcctacctggtctggaaa

SEQ ID NO: 1516 - DNA, 165 bp, Artificial Sequence
  Affymetrix ID 2748234
cgaggtttatgttgtgttaggctcatgagaaggcaagaaattttattatttaaatgttttctccagtaatgtattggattcaagccattgagatttggggagtgtttcagtgacttatttgggcaaaacagaatatttgaaattggcattgtctcagaatctggc

SEQ ID NO: 1517 - DNA, 341 bp, Artificial Sequence
  Affymetrix ID 3630746
gactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactc

SEQ ID NO: 1518 - DNA, 121 bp, Artificial Sequence
  Affymetrix ID 3004500
ctcatgcttcaaaggcatattctcaagaaacaggtgtaatttgtgcagataatcacacctgggaagggatcacagagaaggagaaaaagaaagaaatggcttattctgaggtgaatgtgtc

SEQ ID NO: 1519 - DNA, 171 bp, Artificial Sequence
  Affymetrix ID 3552925
tgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcacc

SEQ ID NO: 1520 - DNA, 132 bp, Artificial Sequence
  Affymetrix ID 3649810
cagcaagaggtgcaggttgagtatttggaggtggtatatttggccagactttagccgcatcgattatgctatttcttgctggctgttttaaattttttttaaaaaggaggaggtgtcagatacatcatttca

SEQ ID NO: 1521 - DNA, 25 bp, Artificial Sequence
  Affymetrix ID 2782685
aaaactagggctgtccaggcttaca

SEQ ID NO: 1522 - DNA, 25 bp, Artificial Sequence
  Affymetrix ID 3166121
caaaagcctgctgctgggtagatag

SEQ ID NO: 1523 - DNA, 398 bp, Artificial Sequence
  Affymetrix ID 2524769
agtgtagtgcagcattgcctctggaactggcctgattcttgcctcataaaattcttgtgaccaataaatgaaattctacacatttttatgtgtctaaaatcccaagactagtatctgacacatggttagctctcaatatattttagctactgctattatcattattggtagtactattaaacattttgaaacagaaaatcacttggggctggtcacggtggcacacgcctgtaatcctagcatgtggagaggccgaggcaggtggatcactggagctcaggagttcaagaccagcctgaccaaatggtaaaatcctgtctctaccaaaaaaatacaaaacttagatgggcgtgatggcatgcccctgtagtcccagctactcaacagggtggggtaaa

SEQ ID NO: 1524 - DNA, 284 bp, Artificial Sequence
  Affymetrix ID 3101675
ttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatga

SEQ ID NO: 1525 - DNA, 521 bp, Artificial Sequence
  Affymetrix ID 3633418
cacctctcacttgcgtatgaagacaaacaaatactggaagatgctgctgctctgattatccaccatgtgaagaggcagacaggcattcagaaggaggacaaatataagataaaacaaatcatgcatcattttattccagatttgctctttgcccaaagaggtgatctctcagatgtggaggaagaggaagaagaagagatggatgtagatgaagccacaggggcagttaagaagcacaatggtgttgggggcagtccccctaagtccaagttactgtttagtaacacagcagctcaaaaattaagaggaatggatgaagtatacaacctcttctatgtcaacaacaactggtatatttttatgcgactgcaccagattctctgcctgaggctgctacggatttgttcccaagccgaacggcaaattgaagaagaaaaccgagagagagaatgggaacgggaagtgctgggcataaagcgagacaagagtgacagccctgccattcagctacgtctcaaaga

SEQ ID NO: 1526 - DNA, 341 bp, Artificial Sequence
  Affymetrix ID 3904327
ttccaaaggtcgctaaagatactgttactactattgagatattattggctacttcacgtttacatagtaaatgtttgcagcatataacattacagactcataaacccataattaacttataagtgttaatggacaactgtgctttgatttttgcctttagtgataagaaaacaaagtagtgaaatgggtcactcctcaaagcatggaacattttaactttgcctagtaaggaaaaacaaaacaaaatatagcaattacatgtggaaccgtaacctgcaaaagtaacacaaatattgtctcaaaaggtacaaataggttgtacctggaccttaagcagcatg

SEQ ID NO: 1527 - DNA, 48 bp, Artificial Sequence
  Affymetrix ID 2652509
gcaccaattgacaacggttcaaaaatcaccaactaccttttagagtgg

SEQ ID NO: 1528 - DNA, 247 bp, Artificial Sequence
  Affymetrix ID 2441680
aggcaagagccctttcgtgcaagtaagcaattttgctgcctcccattttttttttttttttcaatctgtttgggactttgagggctggggtgggaaggtagtggaatggaatagataaacagccagtcaagagctgtggggaggttgacagaattggggtgcaggtacatgtaggatacacagaagctttgtgtctgtggaggctgtatgagtctgtgggtgagcagcatgtctaagtgggtggaaa

SEQ ID NO: 1529 - DNA, 27 bp, Artificial Sequence
  Affymetrix ID 2694895
atgccttggagacgagcccagaaggag

SEQ ID NO: 1530 - DNA, 168 bp, Artificial Sequence
  Affymetrix ID 3048170
tcctatcatagctggcaccgtgttcatgcctgtggtattccctgtatccctattcctgggaagcagcccaggagggggattcccttggcctctccagggtcaggtcacctttcccttcattagtgtgatgggaccttcagaagagaagcactttctgcggccaaactg

SEQ ID NO: 1531 - DNA, 88 bp, Artificial Sequence
  Affymetrix ID 3085948
gaggccggtagtgctgaatggacatggggctggatgaaaagacttccgcctgcctctctcagccccggaatcgccatgagctgctatt

SEQ ID NO: 1532 - DNA, 81 bp, Artificial Sequence
  Affymetrix ID 3300246
ggcctttccttggtgtgacacttgaactagtcgattttttgaaggctataacctaacctcgactatttgttgttatgtgca

SEQ ID NO: 1533 - DNA, 69 bp, Artificial Sequence
  Affymetrix ID 3822344
ttggagacaccatgttagtcgtggctggtctccaactcctgacctcgggtgatccgcgccccgcggcct

SEQ ID NO: 1534 - DNA, 25 bp, Artificial Sequence
  Affymetrix ID 2345520
aagcctgtttgagagcaggactgat

SEQ ID NO: 1535 - DNA, 31 bp, Artificial Sequence
  Affymetrix ID 2549493
gctccggccgagagaagccaccattcctttc

SEQ ID NO: 1536 - DNA, 97 bp, Artificial Sequence
  Affymetrix ID 2788417
gaagagttactggaagcggcacatggtgattcacacaggtttaaaaagtcatcagtgtccgctctgtccattccggtgtgctcgcaaggacaatctc

SEQ ID NO: 1537 - DNA, 26 bp, Artificial Sequence
  Affymetrix ID 2544515
actatgtgaccttcatggtgggggag

SEQ ID NO: 1538 - DNA, 79 bp, Artificial Sequence
  Affymetrix ID 3329911
ccactgtcagaccacggaatgatgtggcccacaagcagctctcagcttttggagagtatgtggctgaaatcttgcccaa

SEQ ID NO: 1539 - DNA, 307 bp, Artificial Sequence
  Affymetrix ID 3467685
cagggagctgcatgtccaactgttctcaggggagaaagtttggccttctctaggaacagacggagagaaggcaagggatcctaagggagatggtgcaagggcttttggggagtttggggtttatccaaaatgtagtagagaagagggttcttgaagagttttcagcagggatgggacatgtgggatttgtgtaaagcagggagcaaactatggctcaagggcctgctttggctcactgcctgtttttggaaacaaagttttattggatcacagacacaccattagttttcttaggagctacaaaggc

SEQ ID NO: 1540 - DNA, 27 bp, Artificial Sequence
  Affymetrix ID 2535364
atcaaggaagtcgagtaaaacacttct

SEQ ID NO: 1541 - DNA, 80 bp, Artificial Sequence
  Affymetrix ID 2979944
gcagcaaataggtgaaagattgaatgaatgggcagtcttcagtgaaaagaacaaggaactctgtgagtggttgactcaaa

SEQ ID NO: 1542 - DNA, 320 bp, Artificial Sequence
  Affymetrix ID 3210881
atggctctacagcaccggattttgcatcagaatcccttcgagtttcttatcttcaccatctgtagcatttagattgaaaaggcttacctgggttttctttttttgtgttttatgatctcaagctattgggagtagaccaattcgtgtggctcaatatgagagttaaagttacgtcagaaggtaatgaaagctgattttgcccttttattaactatagtattttaatcctggtatgtaaaattattactcatttgtgcctaatgcagataatgggaagcagctcactgtggtaaagtaggggcattaagcacaggtgcaac

SEQ ID NO: 1543 - DNA, 80 bp, Artificial Sequence
  Affymetrix ID 3984493
ccagggaaatatgggaactgtgagaggcagcaggcaagttatgggcagaggcagatacaatgagttcatgtgggaaattt

SEQ ID NO: 1544 - DNA, 25 bp, Artificial Sequence
  Affymetrix ID 3294206
ttttttctgcactcccattgcttta

SEQ ID NO: 1545 - DNA, 30 bp, Artificial Sequence
  Affymetrix ID 2389550
atgtattggtggacagcatctaggaagaga

SEQ ID NO: 1546 - DNA, 263 bp, Artificial Sequence
  Affymetrix ID 2593736
gctgtaacactttactatgtctatgcaaatacacatttaaacaatataggaagatttcaataaccaaactaactgtacaaaaaataaacaaattaactttattacattgctacttcaacttcagtccttacattgatttgttttttaaaaaataccagtttgaaacacattactgaaagtgagtgtacacaataaatagaaaatagggatgcatagtgctggagacattcaaccaacttatcttcatctgttgcctactgttg

SEQ ID NO: 1547 - DNA, 33 bp, Artificial Sequence
  Affymetrix ID 3315642
gaatgcagacgggtcaggcgctgtgaacttcct

SEQ ID NO: 1548 - DNA, 25 bp, Artificial Sequence
  Affymetrix ID 2638195
gtcaacgaggggaatccactctgcc

SEQ ID NO: 1549 - DNA, 44 bp, Artificial Sequence
  Affymetrix ID 3973655
cagtttggcaaagagcatgccactgttcctgctgtctatcaaag

SEQ ID NO: 1550 - DNA, 224 bp, Artificial Sequence
  Affymetrix ID 2409486
tctgaaatccgacatcccagtgtccattctggggcacagcttcccctcctttcaagtctctctcttcctccctctccacaacacagaggcctttagctccccagcccttactgttcagtgcgtccacccctccttgtctagaccctgaagtatattacatcagctactctcttgtgagctcctccagtactctgccccttgtccttctattgccctagtctagg

SEQ ID NO: 1551 - DNA, 189 bp, Artificial Sequence
  Affymetrix ID 2635963
cctgcctgtccggaaggaagactttgatttgcggagccatgtagagactgctggccacaatattgacacctgttaccatgtatcaatcacagagaagacctgccgaggattcctcatcaaaatgggtgggaaaattaaaacgtggaaaaaacgttggtttgtttttgatcggaacaagcgaacattctc

SEQ ID NO: 1552 - DNA, 112 bp, Artificial Sequence
  Affymetrix ID 3730508
tccacaatgttgctgccttgctctgccgctcacctcagctgacagcctatcgggagcagcttcttcgggaacctcacctgcagagcatgctgagccttcgttcctgtgttca

SEQ ID NO: 1553 - DNA, 62 bp, Artificial Sequence
  Affymetrix ID 2512118
ggcatatgtttggtatctctggtccttagttcctgaacaattctgggctaatgctgtagtca

SEQ ID NO: 1554 - DNA, 146 bp, Artificial Sequence
  Affymetrix ID 3181032
tgcttctaacaaatccgccctgtcacatgcatatgctttctcaacattcactgtcaaaaatgccctaccaggacacaacatagtgacaataacacattcaatttaaggataatggttgagagggaaccagctaagaacttacaata

SEQ ID NO: 1555 - DNA, 25 bp, Artificial Sequence
  Affymetrix ID 2401404
aggcctctggatggcagaaggaaag

SEQ ID NO: 1556 - DNA, 40 bp, Artificial Sequence
  Affymetrix ID 2496802
tgatctttggtcttgtggcattacagccattgagatggca

SEQ ID NO: 1557 - DNA, 42 bp, Artificial Sequence
  Affymetrix ID 3048180
tcagatttactttcccggagtagtcacaggactgggcagtga

SEQ ID NO: 1558 - DNA, 62 bp, Artificial Sequence
  Affymetrix ID 3436406
ctctgtgccttatcaggagagggtgactctgtgccgactttacaaggctatgggaaggacac

SEQ ID NO: 1559 - DNA, 29 bp, Artificial Sequence
  Affymetrix ID 3840203
gctgtcgtagagtggcaatcatcagtggc

SEQ ID NO: 1560 - DNA, 58 bp, Artificial Sequence
  Affymetrix ID 2633650
ctggctgaaatacgccagcaaatccccgtttttagacagaagcgatcagacctctatg

SEQ ID NO: 1561 - DNA, 176 bp, Artificial Sequence
  Affymetrix ID 2835873
tgatcaaatagtgccgtctgcctggagtacagcatgggggaagaggtttggctgtgttttgatgtagtcactgcccatagtgttgtagttgcttcattttgatgtgtcatacagctaaagatgctccctttaggtcatttttgttgccgctgcctctgcggcttgttactactgtt

SEQ ID NO: 1562 - DNA, 58 bp, Artificial Sequence
  Affymetrix ID 2849540
agaagacaagaggaagccgttctgctggcatttcgtcgggatgaagacaacacagcca

SEQ ID NO: 1563 - DNA, 28 bp, Artificial Sequence
  Affymetrix ID 2986834
ctggccgtgtttcctgtgagttttgagg

SEQ ID NO: 1564 - DNA, 206 bp, Artificial Sequence
  Affymetrix ID 3222790
tgctgttctgcttctcccattcttgcatagagtaatggagttagtgaaaatgggctttcttttacaacacaaagtgttgctcttctttctcctagggagaaagtagtaagctctgtgggtgtaggaggaggaaaatagcaggagcttagccaaggagggtgctgcagcacatgtgggtcttcatagtccggaagggtgagtgacac

SEQ ID NO: 1565 - DNA, 328 bp, Artificial Sequence
  Affymetrix ID 3317133
ccaaaaggactgtcgtggcagagcagccatggccaagtggactcagggttcattttcggaacccctttaagcttatagaaagtccccatcatcacccagctcggccccggggcaccgagtccgtctggtgtggggcgtcctttcgacagagcctcctccacaaacccagactctggcttccaccagggccccggacacctgcttcctcagggcagacagagaggggtgacacactgcaccctgtggctgggaaaaggggcctgggactgtgcccgtctgggacggagcagagccaccatcccatgcaggcactatcaccgcaggcaaa

SEQ ID NO: 1566 - DNA, 91 bp, Artificial Sequence
  Affymetrix ID 3600340
agggccactcaaccatgcgctctgggaggagtgggctgagatggggctgcttggtcagccctgactgtgcttttgatctttgggcgtcacc

SEQ ID NO: 1567 - DNA, 175 bp, Artificial Sequence
  Affymetrix ID 3929187
ctggccaccagggaacagttacgtaaattatttgatgtgtctttttaacaagatattaggaagtgctcggcattgttaggattttttttggccacgtggaaaaacacacatgatataaagcaaaggaaaataaggcagtctgcaaatggatctgcttagaactgccattacgtaa

SEQ ID NO: 1568 - DNA, 193 bp, Artificial Sequence
  Affymetrix ID 3989061
cttgctctgtcataccttgtggaaatgtaaaagatcaatgacagctagccttttcacacaattatttatgcctcggccctctaattgacacagttacccctagcactcatcgttgtgatcacctgcagccaagacgctgattttctgctcctatagcctggcaaccttgtggtacatgggactacgtccttta

SEQ ID NO: 1569 - DNA, 25 bp, Artificial Sequence
  Affymetrix ID 2735839
tatacatatgtctgcctctaataaa

SEQ ID NO: 1570 - DNA, 35 bp, Artificial Sequence
  Affymetrix ID 3660480
tgagaccgcaattccagcacgcattggcaggacct

SEQ ID NO: 1571 - DNA, 43 bp, Artificial Sequence
  Affymetrix ID 2655657
tgggaggaggacgtctttgggattccttctcttcatgagctgc

SEQ ID NO: 1572 - DNA, 61 bp, Artificial Sequence
  Affymetrix ID 2848543
agcataaagaaagttggcctgggttttcgtgactcggcagggtccactcagtttaaaatgc

SEQ ID NO: 1573 - DNA, 43 bp, Artificial Sequence
  Affymetrix ID 3397172
ctgccgtgggcccattgaccagagcgacctgctgtctgatgcc

SEQ ID NO: 1574 - DNA, 25 bp, Artificial Sequence
  Affymetrix ID 3790842
atgtggcgaatgggtagaagaatgt

SEQ ID NO: 1575 - DNA, 55 bp, Artificial Sequence
  Affymetrix ID 2824108
ttttctgattcactaccactgctggtgttacagcgtgaacgtgacctgaagacaa

SEQ ID NO: 1576 - DNA, 74 bp, Artificial Sequence
  Affymetrix ID 3361136
agaagcaggtataagccaaatgttgagagttagagaatgccagcctgcagttgtcatcacccaggcttagtacc

SEQ ID NO: 1577 - DNA, 25 bp, Artificial Sequence
  Affymetrix ID 3971846
atgttcactcaggctccttggtgtg

SEQ ID NO: 1578 - DNA, 28 bp, Artificial Sequence
  Affymetrix ID 3294447
gtgagttttccggatatgtagaaagtgg

SEQ ID NO: 1579 - DNA, 818 bp, Artificial Sequence
  Affymetrix ID 3850170
gttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagatttttgttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctc

SEQ ID NO: 1580 - DNA, 81 bp, Artificial Sequence
  Affymetrix ID 3918219
tgcggattcgtctgctccacgcagggtgctctgacgtactctgtgtggcctggagctcagaaacctgtgctggactcagtg

SEQ ID NO: 1581 - DNA, 27 bp, Artificial Sequence
  Affymetrix ID 2370552
gttggggtgaactgaacctgtccattt

SEQ ID NO: 1582 - DNA, 527 bp, Artificial Sequence
  Affymetrix ID 3476124
gagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtg

SEQ ID NO: 1583 - DNA, 841 bp, Artificial Sequence
  Affymetrix ID 3929424
ctgttgctgattttggtgacacatctctgttgatatcagtaaatatcaattgataagtaaaaaaatatgcaagtcttaacttggatgtctttcatcttgcatgtgctcacctccctcccctctcacccagtcgtttgggttgtttgcctccccttactgtcatatcttcatagtgtggaactaaaacgtagaaatgagggaagtatagtggacagatgtttcccccaccccttcttttacctaggcaagagattaggggagtcttttttgattaaagagagtaggtccaaaataaagaccctgaaacactaaaatctggggatccccaacaaaagaactggctcagtacctagtgatccgacggagacacctctgttagacagctcctgcccacacacacagcttccagtcttgctcttctatatgaacaggcagttaacgatgatcataaggaccaacctgagcagcagaaccaaagggactgaggaaacagacagtgctggtacaagtatgcaagttttctgtaaacagattactttcaaacagttgggagccccagggagataatagaaggtatcctactcaacaggagtatatagaatgctgtagaagaggaatattgtaagaacaagaactatctcttgaaaactaaaaatatgataactgaaatataaatttaaataggattggaagctaaagctaggaaattaccctagaatgttttttgagaaatggaaaatacgaagaccaaaaaaataaaataaaactatgctgtgaaagagaaagattagcatttgagaaggcggaagttggtcctgctcagatgcggttttcagatgcc

SEQ ID NO: 1584 - DNA, 27 bp, Artificial Sequence
  Affymetrix ID 2418445
aggtttcaacccaactggacctgcttg

SEQ ID NO: 1585 - DNA, 27 bp, Artificial Sequence
  Affymetrix ID 2977983
aattctaccaaatatctggctgggtag

SEQ ID NO: 1586 - DNA, 160 bp, Artificial Sequence
  Affymetrix ID 3074397
ttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaa

SEQ ID NO: 1587 - DNA, 460 bp, Artificial Sequence
  Affymetrix ID 3320669
cggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgta

SEQ ID NO: 1588 - DNA, 61 bp, Artificial Sequence
  Affymetrix ID 3562057
gagcaaaaatattgtcaggtttcttgctgtggttctggatgttcagtagcaggctcatttg

SEQ ID NO: 1589 - DNA, 52 bp, Artificial Sequence
  Affymetrix ID 3924690
gggcctcgtggagcattcgtactttgagcgtccacaggtggcttctgtgaga

SEQ ID NO: 1590 - DNA, 146 bp, Artificial Sequence
  Affymetrix ID 3029146
agtcaactcggggagtcaaattaggaaaggcttcgaaggatgggcaggacgtaagaatccagagaggagagggatgtttggagaacagaaagtggaaggttcctgtaggaaaatgatagagctatacttggagaggcaagcggggc

SEQ ID NO: 1591 - DNA, 163 bp, Artificial Sequence
  Affymetrix ID 2480430
tcttcactgaaggtgccagcctatgggtggactcgtgatctagacctaaagggttagtgtgagttcctagaggaaaagaaagccatgaggcagattgtggaaggctttgaaggccaggtggagggccttgaactttattccatagacaatggggagctattga

SEQ ID NO: 1592 - DNA, 51 bp, Artificial Sequence
  Affymetrix ID 2923442
ctgggaagaacttcaggctgttgttcagggcatggatatcaccactgtcca

SEQ ID NO: 1593 - DNA, 55 bp, Artificial Sequence
  Affymetrix ID 3393487
cctctggaacctgaggcggctgcttgaacctttggatgcaaatgtcgatgcttaa

SEQ ID NO: 1594 - DNA, 77 bp, Artificial Sequence
  Affymetrix ID 3879288
gctttcaagaatacggccatgtctgcattgttggcttacacgcagacacacgctcgggtttttcatttggcagggtg

SEQ ID NO: 1595 - DNA, 153 bp, Artificial Sequence
  Affymetrix ID 2889490
catctcatccaaatacacgctattgagaaggcgagcctgacctccctcttacagataaagtcagctttcagaggctcagggtgggggggcctgcccgaggccataatgctacccaccccctcctcctaaccactggtctgttggaataaccca

SEQ ID NO: 1596 - DNA, 135 bp, Artificial Sequence
  Affymetrix ID 2915334
agattggttgagagtctccgtttgccacaggtgccaactctccattctcaagtgttcctgtttttcagagtgttacttttaagaatgtctccccaacatcttacctcactctggcctaccatgattacagaactt

SEQ ID NO: 1597 - DNA, 463 bp, Artificial Sequence
  Affymetrix ID 3186622
ctcatattaggatgtggacctgtccaaatcttcagggagtcctccctccccaggccaggcaatttctccagcaccaaggtaaccactgttttgttctctattgctatggattggttttgcttatttgtaaatttatttgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaa

SEQ ID NO: 1598 - DNA, 118 bp, Artificial Sequence
  Affymetrix ID 3720992
catttctatggttattcgtggaatgactctttgaccacgcggagaaggcaaaacttcagccatttgtgtttttttccccttggccttcccccctttcccaggaagtccgacttgttca

SEQ ID NO: 1599 - DNA, 43 bp, Artificial Sequence
  Affymetrix ID 3916840
tggcaatttcaacagttcgtcactgcacgctgcctcttaaagg

SEQ ID NO: 1600 - DNA, 30 bp, Artificial Sequence
  Affymetrix ID 3959370
catgggcttctcagatccaggtgatgccca

SEQ ID NO: 1601 - DNA, 91 bp, Artificial Sequence
  Affymetrix ID 2571999
tggtttcactcagcgcaggcgaatggctcttgggattgttattcttctgcttgttgatgtgatatgggttgcttcctctgaacttacttcg

SEQ ID NO: 1602 - DNA, 40 bp, Artificial Sequence
  Affymetrix ID 3757901
tatttccttattacatgttccagacaggagtgctagccca

SEQ ID NO: 1603 - DNA, 81 bp, Artificial Sequence
  Affymetrix ID 4002896
ctttcatggagcaccgctgctcacgacctgttacagtctagaaaaatggaaaaactgaaaatgggtatctatgccacctaa

SEQ ID NO: 1604 - DNA, 26 bp, Artificial Sequence
  Affymetrix ID 4013965
aaaatctactgtggagggagtgcaaa

SEQ ID NO: 1605 - DNA, 111 bp, Artificial Sequence
  Affymetrix ID 2327098
atacttgagagtaaatgaactgctcttgttactttactatgtcaattacaaagcttaaaattcacacaagccacacgacatatttaagaatgcatgtgttgggccaggtgc

SEQ ID NO: 1606 - DNA, 38 bp, Artificial Sequence
  Affymetrix ID 2381607
gacatcagagtggaacttgggcgatgctgccaacatga

SEQ ID NO: 1607 - DNA, 429 bp, Artificial Sequence
  Affymetrix ID 2995272
cactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttc

SEQ ID NO: 1608 - DNA, 103 bp, Artificial Sequence
  Affymetrix ID 3261789
gctccaacctgagtggtgtcagtgccaagtgtgcctgggatgacctgagccggccccccgaggatgacgaggacagccggagcatctgcatcggcacacagcc

SEQ ID NO: 1609 - DNA, 1290 bp, Artificial Sequence
  Affymetrix ID 3934119
tgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaa

SEQ ID NO: 1610 - DNA, 343 bp, Artificial Sequence
  Affymetrix ID 2748304
actcaaggtctgtccatgctggtgacttagagtagtgggatttaaaccagaggatgcacacttggaggcacttgaagatgtttcaagggacatgcaggcattgaatatttaaaggaaattaattgccgattcttagatcttgagtgttaatcagttctaacactgaccgtcctgagaaaatgcctatggcccaggtgacctgctggttttcctttcacaccttctctttcatgattaccattctttaaagggaagacatacctttcacctaccccttatcagagtgccaagtagggggataattaaaatactgctggggctgctgggaaagtgagtgactcta

SEQ ID NO: 1611 - DNA, 59 bp, Artificial Sequence
  Affymetrix ID 2358329
ctccagcacccatgtcctgggggcagcagctgaacaattcctaggtgctgttctctgca

SEQ ID NO: 1612 - DNA, 147 bp, Artificial Sequence
  Affymetrix ID 2636804
tcttatcacaacactgcggcgggaaaatcaggaaatgggttcacctttcagcagtcaccacagtaaacttcattgagaacatacatgcccagatatctcttctgtgcacatgtatatgttaacagctagccattcagccaacaggta

SEQ ID NO: 1613 - DNA, 95 bp, Artificial Sequence
  Affymetrix ID 2907584
cagggaagtcactaatgggagagtgggaggtatttgaaaagggggtttcgtgggtagtttttgtcctactttcatctctcttttgatcccgacag

SEQ ID NO: 1614 - DNA, 103 bp, Artificial Sequence
  Affymetrix ID 3185561
gcgagtcgactcacctacctcttttcaagccggcctagccccttcccggaacctcggctcccccccaacgaaactactgctaagccaactggactacacttcc

SEQ ID NO: 1615 - DNA, 105 bp, Artificial Sequence
  Affymetrix ID 3752751
atgggttcaagacctgtttatgtgcgagaacaacaggctttggtgctggtgactcaccaagatgggaaatacaggaaaagaagcagggatgtggtagcagagtgt

SEQ ID NO: 1616 - DNA, 25 bp, Artificial Sequence
  Affymetrix ID 2366872
ttcccatccctgctctagcagcctg

SEQ ID NO: 1617 - DNA, 130 bp, Artificial Sequence
  Affymetrix ID 2389086
tgagagaggtttctattgttcactttagaaaaatgtaggtcaatgtaatgggtgatatctgttcttaattattctaagaattaaatcctgtatgttatcagtcacctattatatggcacaccctcagggg

SEQ ID NO: 1618 - DNA, 28 bp, Artificial Sequence
  Affymetrix ID 2523976
aggcaaggggtaaagtccaggatgaggc

SEQ ID NO: 1619 - DNA, 123 bp, Artificial Sequence
  Affymetrix ID 3394423
gcagttcacccatccagtacgagttcagcctgacccgtgagacaaagaagcacgtgctctttggcactgtgggggtgcctgagcacacataccgctcccgaaccaacttcaccagcaaataca

SEQ ID NO: 1620 - DNA, 72 bp, Artificial Sequence
  Affymetrix ID 3510096
agggagaaacggtgcgattcacatattccgcgagatcatcaagccagcagagaaatccctccatgaaaagtt

SEQ ID NO: 1621 - DNA, 42 bp, Artificial Sequence
  Affymetrix ID 2974447
atggattacgggcttttatgtgggcagcaacttgtgcctcag

SEQ ID NO: 1622 - DNA, 56 bp, Artificial Sequence
  Affymetrix ID 3000375
gtcacttttgtggcctcttggctgtaccttccctgggacaggacacggtcctttct

SEQ ID NO: 1623 - DNA, 119 bp, Artificial Sequence
  Affymetrix ID 3498077
gcagttatgtatacacagggcaatcatcagaccataatcattactgttcgaggccagaacagagacgactagctctctgtgtgcctttcccaagtctcaccgtgatggactgtcctctc

SEQ ID NO: 1624 - DNA, 239 bp, Artificial Sequence
  Affymetrix ID 3670758
gtcttcagagctagccggctgtgtcttctccccgtttctttcactggtgaataacctttcgtttgaaccagccttgattgttctctccatgttccactgtggctccccatggacactgctaggtggaatctctgagaaaacaggcacttcgcagtcggcgcatctttctctgccagcttagggattgccgtcaaggtggaggaagggtattttggccatgttcggagtcgttgttttta

SEQ ID NO: 1625 - DNA, 428 bp, Artificial Sequence
  Affymetrix ID 3418194
cagttagctgtagagatgtgatttagcaaagttggttataaagtgggtttttgtaaattgtttccttattactgttctttgtagaattgaagatgtattctctcccagcaaaatagttcacctgcagatcattgaaaagtttggctgaagaaaggggttattttggtgtgggggtaggaggcttctgtgggctgggcatggtggcttacatttgtaatcccagcactttgggaggctgaggcaggaggatcacttgaggccgggagttcaagacttgcctgaccaacataatgaatctcccatctctacaaaaagaatcagccaggcgtggtggcgcacacctgtagtcccagccactcaggatgctgaggcgggatggtctcttgaacttgggagattgaggctgcagtggagcagtactcgtaccc

SEQ ID NO: 1626 - DNA, 30 bp, Artificial Sequence
  Affymetrix ID 3687863
gaggtggcgaaatgtcagacacaaacggac

SEQ ID NO: 1627 - DNA, 25 bp, Artificial Sequence
  Affymetrix ID 2438168
gggaatatagagaggctgctgagag

SEQ ID NO: 1628 - DNA, 153 bp, Artificial Sequence
  Affymetrix ID 3059966
ggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatc

SEQ ID NO: 1629 - DNA, 29 bp, Artificial Sequence
  Affymetrix ID 3281916
aaaaagtaaggtggatatgtgcagtggct

SEQ ID NO: 1630 - DNA, 42 bp, Artificial Sequence
  Affymetrix ID 2838994
gtagaaaggggaatgtgtactgctagaggttacgggctttga

SEQ ID NO: 1631 - DNA, 678 bp, Artificial Sequence
  Affymetrix ID 2724513
gtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctga

SEQ ID NO: 1632 - DNA, 504 bp, Artificial Sequence
  Affymetrix ID 2415597
ccctgttaatcttgtggtcaccatacactcttgggttagctgtcaaattagggtttctccaccctgcttttgtataatgaagtttctaatcctaaatgcaggatgccccattctgagcctgtttgtatttaacagaaaatagggattttcgtcccatttttatcttaccaattcactccccaactgtgccagaatgcccagaggtaatagccttttggaaggagctttcccatgctacattccagcagggtaaaacaatctgaaaatgttcttgccccttttatcactgagttctccatatcccaggctattttataaatagaatttttccctacagaaaatatgtaaagccattgcgaagagaaaacttttctacacatagaaaacatgataatttctcattagttttggaacaatacaggtctactctaagttgtttcttattctggagtacaaaatttgcattttataatgtaaattgggacactgtatactagctttctc

SEQ ID NO: 1633 - DNA, 157 bp, Artificial Sequence
  Affymetrix ID 2818227
cactatgtcaactgggtgtctttgctaagtttggcatcaatatggtgacctctcgggagcaggggaccactaggttacataaggaggggtgaactggcccagattggaaatggagcaggtcaaaactcccatgctaaccagtagtgagatggagcct

SEQ ID NO: 1634 - DNA, 126 bp, Artificial Sequence
  Affymetrix ID 3412324
atatacacctatctcaaccatttttttaactgatttttttcctaaatattcttctttacctttaacaaggcataggctgttgcaggacagtggttattaaagcatgggttgaacttccaaaatata

SEQ ID NO: 1635 - DNA, 52 bp, Artificial Sequence
  Affymetrix ID 3598210
gtcggggccatatggctgtgctgcagcgacttgtggacatcgggctggacct

SEQ ID NO: 1636 - DNA, 1514 bp, Artificial Sequence
  Affymetrix ID 3728164
cttgctaacgctcgccagagaaatattccgtggaggtgttaaaacaagactagtggaaagaaatggtaacttaaaaagaaagaaaatccatggcagtgaagaacagatttcatattagtactgtcataatattctctaatgtatcatataaataaaaatctgtttagaccagaattttaataagtcaccaaaggaaggttttgaatcctacagtttatgtatccccctttgcgatgtaaatgttcacatctcaagtgaagtagagtggggagacgcttcggagactagaggctgttaattagtgaggtatattttgatcagggcaagaagactggttcattctatatcttcgtatttctctggatgattatttcattttgtaaaatatgtaagagttcccccccagccccttatctttttaaaaattaaaatggtcatgctcttctaaaaagatgacttaatttgaaggctttggagacatgaggatgatggggatccatcactccctgttctttgctccctttggactggagtgttggctgtctggaagagttttgcttgagctcgtgggttattttcttctatgtggaggaaccaagagactctttagcatctttcagcaagagcgaggtctgggtgtactcaccatctgtcttaattatccttgtgtataagaaaacattcccatcttttcccaattgccatttccttccttaacttttagaggccagaacctcatctgttgatgcagggagatctcacttctttaacctatttctagttgccttcagtcacagcggggtggccaggggcgagtcacttaagcctccccaaggctcagtttcctcctttgtaaaagagggagaattatagtactcactgcctgcagttagttgtttggaggataaatgcaaaattcttcactgggagtctggcataaaacagcactccgcaaatgtctgttgatcttattattatagaattattatttttattattattatttttaagacggagcctcactctgtcgcccaggctggagtgcagtggtgagatcttggctcactgcaacctccgcctcccgggttcaagcaattctcccgcctcagcctcccgactagctgggattacaggcacctgccatcatgcctggctaatttttgtatttttgtagaaatggggtttcaccatgttggccaggctggtcttgaactcctgacctcaggtgatccacctgccttggcctcccaaagtgctgggattacaggcatgagccaccgtgcccgaccagataattattttaatagaataaaaaaaagtacaatggtgaaatgactgaaggaaaatcttaattggaatgtaagctccctgagggcagggaactgttggtggctgctgtttggtaactaaatgaacgaactgagtccagcctgcttttttcaccgtggaggtagctgctacccagtaaagttacgttggttgcttcagatccacacttaggttgtagcagggct

SEQ ID NO: 1637 - DNA, 257 bp, Artificial Sequence
  Affymetrix ID 2779706
acctggtaaagtgagaagagtgatcaggagaagataatttgcatagtatatatagatttctattccatttatataaaacccttgaatggtaccttagtagaaacaatataaaataaagctaatatgggttagatgataatgtggttaagtggatttttttttcctgtctgaacaaaagaactgacaatttaatcaatagacccctgtcagtctggagagatgcttctagtggtcagcacggcactctggtctttgtg

SEQ ID NO: 1638 - DNA, 33 bp, Artificial Sequence
  Affymetrix ID 3394582
aacagctcaacatgtgtcgggatgtccagggaa

SEQ ID NO: 1639 - DNA, 74 bp, Artificial Sequence
  Affymetrix ID 2429120
catattttgaaagcacggtgtgatcctgtccctgctgctaatggagcaatacgtttccattgtgatcccacctt

SEQ ID NO: 1640 - DNA, 340 bp, Artificial Sequence
  Affymetrix ID 3428756
cagctaaggtaaatctgcttggtccaaacaaaacaaaacaaaacaaaacaccagactgcaacaataacaggaaaagatcctcttcagtgatttatgttgttctcttactttcataactagtttgaatgcaaggctggtaaagggatacacagagaatcattattttaaataacaaaagccattcaaaactctctctacctgtcaaggatgttttatgctcccattcttatttgtttggcagtaaacataccttgcccacagtcgccagcatcaaacccacaggacaagacattgcatgcttggtcacagaacttatcagcgagccaggaattcgcacatc

SEQ ID NO: 1641 - DNA, 481 bp, Artificial Sequence
  Affymetrix ID 3595186
ttgtttaggcaaagcacgttatggctttttcttgcctagtttaggtctgtgcttaatgactactggaatagcagcaaacataacatcctgataacatttgggaggaaaagccatatttgaaaattggtgaaatgcaataatctttaaaccaggaatcatcagtttgctaataaaaggtatatggctccaagttacgtattttgtcagggtcctctggcattttcactagtcattttgctagtgtgtacaatgattcctatcttgctgtaaaacttggtgatttttttatattgttgaactaggtgacatgaatattgagtcagatcacataatcttagagtaacacataagtgattatgtagcgttgtgggtggaaacaattctggataaaaagtgcatgacagttcagaactactgtgcaggcagcctgtctgaaatcaggtttaaaaattggccctgtctccagctgactcgttttgtc

SEQ ID NO: 1642 - DNA, 127 bp, Artificial Sequence
  Affymetrix ID 3959259
ctcaagcacagtcatgattggttttgtattttcttctccaggctacataataattttttgacctggttttcttgatgccttataattctgaatgctggacttgtctctttattacctgccagttagc

SEQ ID NO: 1643 - DNA, 27 bp, Artificial Sequence
  Affymetrix ID 2604457
acagcaggaatctgtcagtgtccctga

SEQ ID NO: 1644 - DNA, 145 bp, Artificial Sequence
  Affymetrix ID 2843218
ggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcc

SEQ ID NO: 1645 - DNA, 71 bp, Artificial Sequence
  Affymetrix ID 3039818
gctgacctattgctgaggactatgagaaaaaagttattacagaatgagtcatatggaaaacacttgcaaac

SEQ ID NO: 1646 - DNA, 70 bp, Artificial Sequence
  Affymetrix ID 3483658
gcagacaatccccatcagcttaaggttcccgtcaccagggtttcccttcatcgaaactttgccacagtca

SEQ ID NO: 1647 - DNA, 221 bp, Artificial Sequence
  Affymetrix ID 3605805
tgtagtattcactactccagacctttttcaagttgaattttttttctttttccctatgtctgttcttacgtattttttttaaacttttatttcagtagtgtttggggaacaagtagtgtttggttgcatggaaaagttcttcagtggtgatttctgagattttggtgcacccatcacccaagggtagtcttttttatccatcaagtctgtacccaatgtgt

SEQ ID NO: 1648 - DNA, 45 bp, Artificial Sequence
  Affymetrix ID 3659197
agagagcctagcctgaatatgccacagccgcacagagtttctcct

SEQ ID NO: 1649 - DNA, 192 bp, Artificial Sequence
  Affymetrix ID 3775146
cagttaagtgcagctcggtgagtcccggcagttccttcccggcactggctcgtccctgggttctcaaggttccatgcggccacagcgtccgtccacctgtccacgcgagccacatgctgaaatggaggtggataaaattcatcaggcagctgctgtaacacggaaatgtgcagatgccagagtagcttcgtc

SEQ ID NO: 1650 - DNA, 154 bp, Artificial Sequence
  Affymetrix ID 2534837
tgtgcacgcatgcagcactgcgataacggggcagggggagttaggtgattgcttaaagcacaagtgtgtagggaagaaacaaaggcaggaggggccattaaggagcctgtagagtgtttgggtcgggggctcacatttgtacagagtgagctga

SEQ ID NO: 1651 - DNA, 788 bp, Artificial Sequence
  Affymetrix ID 2705269
aaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctc

SEQ ID NO: 1652 - DNA, 27 bp, Artificial Sequence
  Affymetrix ID 3479382
tcagcaaacagcccgtgggaaaccaag

SEQ ID NO: 1653 - DNA, 328 bp, Artificial Sequence
  Affymetrix ID 2320890
gtttcatgagacagcgatctgcctaaccattcactcctcctagaagcaaaagctaccgtgatcattgaggcacagccggtcttcatatatcctcaaaggagggggattagcttccacatcccttctctattcctggaggtgccagtagtgggagagtcatggcagaagttaccagaggcaagtggggcagaggcaagtagggtatatgtttggatcagtggatcagtgtcctttattgtgcagaaaaagctaaaattacagattcttctgaagggatacatagcagccgtttcaccaatgtccctcagtccatttgtccaggtccaga

SEQ ID NO: 1654 - DNA, 99 bp, Artificial Sequence
  Affymetrix ID 2824597
tgtaggtgctgctttaatgcttggactgatgttattgttgtgggagtggattagttattgtgagcatgggttggttataaaagcaaggtcaaggctggg

SEQ ID NO: 1655 - DNA, 25 bp, Artificial Sequence
  Affymetrix ID 3916352
taatgggcctgagtgtcaccaagag

SEQ ID NO: 1656 - DNA, 26 bp, Artificial Sequence
  Affymetrix ID 2900984
ggaatgaatggctgcgacatggggcc

SEQ ID NO: 1657 - DNA, 1108 bp, Artificial Sequence
  Affymetrix ID 3003162
ccctatgccgatgttgtcctggattaccttttttgtcctgtcttatcacttcgtctcctgtctcgggtttctggctgtctgttcctatttctatttgatgttgtgctctcacttcacacccagcatgtagaatcaccttgctcttccaacttccctgtctgtgccactcaccttgttttactcagcccgttccttagttctctgtggtgaatctgtcacctaagctgtgcattcttcatcggacatgtattttggttctcttgtttccttctccatctctctctccaagcctctcgagccccattcccaagtagctttttttctgactacctttctgggctccaagctatacctgtgtctccttcctgccctgcaatacattaccccaaagtttgtcagattgatctgcttgagttctgttttcttttttcatcacgttttttcttttctctgaaactttcagcagctccctgtttgcagaacataaagacttaactcctgcctggtttttaggggtcccaataatgggattctgcccaacccatccagttctgggtacaagtactgcctgccttacaatctccattcaggtaaggccagggctcctaagagcaggtttggggtccccagcaaagaggagtggctacaaatccatgcgtgactttgtgttggtgaaaaacctgggccccgttgccaggcccctttctggaccccacctgaatcatgtgtactgggcttcctcctgggcactgcctccaatgcagggttgtctattcctgctcatgtcatgcgacgaaaaggaaatgttggacatacatttccctagcagaatccctctttccctgtcctcgattttcattgatcccatgttatttctgaacattcatgagtcacgcatcagatacatttaatatcagatcctaatttaaaaagtaaatgctactcttccaaaagtacacatgatgtggtcactatactgggtcataaagatgtatgggttttcagttagttagacttagaccgttttggaacttttctctgttaaccatttatgtatccctggtcgtatggagctccagtggtgcagtcggttagcacatggtactta

SEQ ID NO: 1658 - DNA, 119 bp, Artificial Sequence
  Affymetrix ID 3743421
ggaacaggagaagccccaattttcagaagagaggggagttgattgagaagtgtaagattgttacttgagaataatcttgagggtatgaaggtagggtaagggagaatggtgataaactc

SEQ ID NO: 1659 - DNA, 56 bp, Artificial Sequence
  Affymetrix ID 2949593
ctggcggcccagtcaccgtgtctgtacaccaagatgcaccttacgccttcctgccc

SEQ ID NO: 1660 - DNA, 57 bp, Artificial Sequence
  Affymetrix ID 3824798
acggcagaagatggtccctcgcgtctctcccatcttccggctatggaaccaacacac

SEQ ID NO: 1661 - DNA, 27 bp, Artificial Sequence
  Affymetrix ID 3933890
tctccgtaaccctataacagtccgata

SEQ ID NO: 1662 - DNA, 68 bp, Artificial Sequence
  Affymetrix ID 3340811
catttatttatgatcaaccagagagactaaacagtggactcatgggtttggactctattgcaattcaa

SEQ ID NO: 1663 - DNA, 35 bp, Artificial Sequence
  Affymetrix ID 3888249
gatgaagaactcaccaacacaagcaagaaggccct

SEQ ID NO: 1664 - DNA, 25 bp, Artificial Sequence
  Affymetrix ID 3932432
atagggaatgtgctttgagctgttt

SEQ ID NO: 1665 - DNA, 27 bp, Artificial Sequence
  Affymetrix ID 3941419
caggaaaagagttggcctggacctgca

SEQ ID NO: 1666 - DNA, 60 bp, Artificial Sequence
  Affymetrix ID 3976987
gttgactgcgtgtccattgttgttatagttggttgaatctgtcccattaattctccttcc

SEQ ID NO: 1667 - DNA, 42 bp, Artificial Sequence
  Affymetrix ID 2892314
acatggccagtactgtttcaggggaatattgggtggcgctgg

SEQ ID NO: 1668 - DNA, 203 bp, Artificial Sequence
  Affymetrix ID 3379157
gggccagagaactttacaatgattatgaagatcaaagggcattagaatcaagctataaagagccactgtttgatgttgggatgtgaggatgctgcaggtggatgtctgcacgttgatggtgagaacatggtcaccctggccctgctgggtctttgctaaagagactgtgctctgttcttggggccgttttcatcacctgatta

SEQ ID NO: 1669 - DNA, 99 bp, Artificial Sequence
  Affymetrix ID 3830022
aggacggtcggcgtgcagagttcctggagtgctggggggcctgagatggttgtatgacgtctggaggattcaggagggtgtatggggtctcaaggacac

SEQ ID NO: 1670 - DNA, 94 bp, Artificial Sequence
  Affymetrix ID 3904149
ccttggttcagctgtccatttcctgtgaccatctcattgacaaggacatcggctccaagtctgacccactctgcgtccttttacaggatgtggg

SEQ ID NO: 1671 - DNA, 164 bp, Artificial Sequence
  Affymetrix ID 2408020
tgaaccatccattgcctaaaactccagcaaccctaaaaggacccaatcaaccagaagaaaaaatactaatacctcatatcatacagcaacctaacatttcaaagtgctttcacatgtgttagttcatgcacacctgacaacagtttaactgagggagccagggc

SEQ ID NO: 1672 - DNA, 337 bp, Artificial Sequence
  Affymetrix ID 2437930
ccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggta

SEQ ID NO: 1673 - DNA, 30 bp, Artificial Sequence
  Affymetrix ID 3264854
ctccacctctttttgtgcgagggcggcctc

SEQ ID NO: 1674 - DNA, 27 bp, Artificial Sequence
  Affymetrix ID 2701275
acttgctggaaaaagtacatgctctcc

SEQ ID NO: 1675 - DNA, 97 bp, Artificial Sequence
  Affymetrix ID 3017578
tatctctgatggttgctagtgaacattaagccctcaatatttgtttaatcagtgctatcaaagtggtttaaatggatgtagtctccaggggtctctg

SEQ ID NO: 1676 - DNA, 32 bp, Artificial Sequence
  Affymetrix ID 3625878
ctacttcagtgagtgggactttagcctgagca

SEQ ID NO: 1677 - DNA, 413 bp, Artificial Sequence
  Affymetrix ID 2438152
cagctccctgagatagatgtaaatcctaagcattgtgggtgttttggtttgatgggactggattgaaagatttacagacttaaattgtaaaggaaggtaatttagagagaggaaggaaataaacattatgttggtttggttataaccactggcttgtctccactgacatggcctgggggtgagtggtgtatttgcaaagctcctttcaggtctgcattaatctctggcattagttggctgtgaccgattagcctcccagttaaagtatgtagtcagttcttagtgatggtaaatgggttactgaggccttcttattacatccaattatgaggtgactatataatttatcttgcaaactgttgagtgtgttctaaacagtatgctgtgggggcgctatcactaattatgctgga

SEQ ID NO: 1678 - DNA, 238 bp, Artificial Sequence
  Affymetrix ID 2786550
gtacccaggaggtttggcatcactcaagaccctcagaatgcttcctctgctttaaatgcttggagtggctctctgtccaaactgtattaccccatccaaactaaatcacctctcactatgtggatgaagcaaacaacagatcttttgtttcgaaatgatttcatgttaactatattccaggatattaagatcttacttaaggaaactgctttgcagtgccagggatctaagctatata

SEQ ID NO: 1679 - DNA, 25 bp, Artificial Sequence
  Affymetrix ID 3122495
cagggacagccggcaaaataagcag

SEQ ID NO: 1680 - DNA, 82 bp, Artificial Sequence
  Affymetrix ID 3252241
cttctccgcaccacatcgcccttactctaaaattgaccacataattggaagtaaaacactcctcagcacaagcaaaataata

SEQ ID NO: 1681 - DNA, 266 bp, Artificial Sequence
  Affymetrix ID 2806568
agagcactcaattcgactatccgtccagctttcacagaatttacttctgagcccacaagactcaaattgtataaggatagagtctgtttcattcatcaacatatccagcacctgacatagttttacatggcacagagtgggtgttcaataaatatttgtcaatgattgaacagaaattttcagcaccaaatgaaagaaacacatgactttgaacaacggcacgagaataccaactgtttgattatgcaacgacaggatcttttggc

SEQ ID NO: 1682 - DNA, 30 bp, Artificial Sequence
  Affymetrix ID 3385452
agttcctaaatgggaacactgccttatgga

SEQ ID NO: 1683 - DNA, 185 bp, Artificial Sequence
  Affymetrix ID 3968192
gatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttg

SEQ ID NO: 1684 - DNA, 179 bp, Artificial Sequence
  Affymetrix ID 2397794
cttctgatcaccaagccacatgtgatgactcctgggcccttcttcctgggacaactgcaccagcttctaatcagctcgcccatctcagcctgacccctctctgcagcctgaagtccagactctctagcctggcaccatagtcctttccttctctctgacctaatcattaaccataaccc

SEQ ID NO: 1685 - DNA, 46 bp, Artificial Sequence
  Affymetrix ID 2412877
cgatgtgacattggggatgcttccaggggaagtttatcttcatatg

SEQ ID NO: 1686 - DNA, 26 bp, Artificial Sequence
  Affymetrix ID 2904959
gtgggctgtatcatggcagagatgct

SEQ ID NO: 1687 - DNA, 27 bp, Artificial Sequence
  Affymetrix ID 3367083
acagactgacagaggtgcatggtggag

SEQ ID NO: 1688 - DNA, 27 bp, Artificial Sequence
  Affymetrix ID 2762520
tttaccatcgtttcattccatccatcc

SEQ ID NO: 1689 - DNA, 1275 bp, Artificial Sequence
  Affymetrix ID 3463535
tgcctgtagctccatacctgtataatcaacagctattaaatatctgctaagcaaactaaactaagcattttcaaaagtaaacttgtgaaacctgatggatttcagtagttgacatcagcatctacttttgctgaagtcagtagcctggacattatttatgacacttatttttttttcccatcttgcccttatccattcattcaccaagccttgttgagtttatcttctgagtatctcattgccatcacaccaatctaggacaccatcatctcttacataggtgattacaatagcctccacactggcctccctgtctccgtttagctcatctcccaatatattttataaaaatgatactgttactttctctgctttaatggcttaccattacctttaaatggagtctgaatcagtggtctccaaaggggggtgatatataagataatctgctagggtgcaggaggaaaatattggaacttttattcatatttacctttttatttgaaaaacactaaggcattaatatttaaaagctactactgtgtaatagttatttagtcattccttctttgctctatgtgtcagatggtcatttggtactaaaggtgtcctgagggaagcatgctttgttcactttctgcatgttgcacaatactataatttgaatgtccatctatgcggatttatgagttatctagtttaactattacaaaatatgtaagtctgggattagggaatttgtggagaaaatcaagtgtttaactgcaaataagatcacattgttgttcagctggtaagatatacaaaatcaaatctgttctcatgaattaagaaaaattacgctgattttgaggttttaagtgaaactttttaaaaaattctcatttttttgtaaggcatccctttctgctttgatagccattaaaaatcaaatattcaaactgatgttagaactagatctttgaatctctgtatcacacggtgttaagatcttcagaaataatgaagcatattcaatattttatttaaaatatttgtgagaacaaacttttgtaccataaataaaacaaattttagtctttttcttatgctctatttttgggatacagacgattattttatattgtcatattgtaaatcctataaaaatggtagataagtaaacatagataccaacatgggtatgtaattatgaataatatttggagatctttagtttaaattcttccataaaatagctttcagggccaggcgtggtagctcagacttctactc

SEQ ID NO: 1690 - DNA, 27 bp, Artificial Sequence
  Affymetrix ID 3533262
tgggggagggaggatactactgagcaa

SEQ ID NO: 1691 - DNA, 68 bp, Artificial Sequence
  Affymetrix ID 3651809
caaagatgagaggtgcgaagttgtccaagtccaacagctcaactgaactttcctaagtggaattgtta

SEQ ID NO: 1692 - DNA, 42 bp, Artificial Sequence
  Affymetrix ID 3719905
ggttttgcatctcatttacttctccattggttcaggataaag

SEQ ID NO: 1693 - DNA, 25 bp, Artificial Sequence
  Affymetrix ID 3744442
ctgagcgtgccatctcccagtggcc

SEQ ID NO: 1694 - DNA, 34 bp, Artificial Sequence
  Affymetrix ID 3994048
gcaagcagcttgtcagacgtgcatgtggtttgga

SEQ ID NO: 1695 - DNA, 194 bp, Artificial Sequence
  Affymetrix ID 2566874
ttccctccaaagtggaagtgagctggagagatctctgggtctgaaagtcacctgctatgttggaggagggtcaggctttttgaggactactctggtcaaggtctgcagacttgcttccctcctttaacccaaatcttattattatggctacacatgtgccacacattatagctccagatactcacgcaaggttc

SEQ ID NO: 1696 - DNA, 26 bp, Artificial Sequence
  Affymetrix ID 3788902
agtttcttttggcaggtggtccagaa

SEQ ID NO: 1697 - DNA, 156 bp, Artificial Sequence
  Affymetrix ID 2684832
aacacaaccatttacgatctcagtcagcagatttactctactcaaggaaaaaaagaaacaatcttattggaagcagatgttgacactgtgtcagttattgaagacggaaggagttcacttgagccattgcagttacaaaggggtattgatggcagt

SEQ ID NO: 1698 - DNA, 204 bp, Artificial Sequence
  Affymetrix ID 2808743
ggccaactgtcaagatgttttgaaggccaatctggaagtatatgttaaaataaagatgtgcataatttctaactgagcaactctactttgtggtatttatcctagagaaacattcacaattatgcccagagagatatatgtagggtatcccttgctacatggtttataacaaaaaaatatattagccaactagggtccattagg

SEQ ID NO: 1699 - DNA, 117 bp, Artificial Sequence
  Affymetrix ID 3311746
tttcctcagtgcattcttggtggtgagattgattggtgagcatcgtataacccactctgggagcatagcctatttgtatttgtgtatgtctatactttgtgaggtttagcccacttc

SEQ ID NO: 1700 - DNA, 25 bp, Artificial Sequence
  Affymetrix ID 2398939
atgaaatggtttggaaaggagcctt

SEQ ID NO: 1701 - DNA, 187 bp, Artificial Sequence
  Affymetrix ID 2948399
agagggcgatcaggtctcattaggccccagggtgtctgaggggtgatctctgccagtggcggtgggcaaggcagaagaggcgtctgctgcagtggaaggatcatgacagcctgagttaaattccacctcttctcagctgtgaggtcttgagtaagtgattttgctactctgagtcttagttactttg

SEQ ID NO: 1702 - DNA, 108 bp, Artificial Sequence
  Affymetrix ID 2974531
tctcattttgattctggcagtgggcccaaatgctaagtgtcttgcccaaagtagaaatttccagttgctacttccatggtgtgccgcacaggcaatggctgagttctt

SEQ ID NO: 1703 - DNA, 307 bp, Artificial Sequence
  Affymetrix ID 3385006
tctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatc

SEQ ID NO: 1704 - DNA, 157 bp, Artificial Sequence
  Affymetrix ID 3777967
gcgagtgactccgtttctttggacctgcggttgagctggcagcagaatggaggggtccgagaaacgggtgagtgtgaatcccttgcagaaatgctctctgggggtctgcccttgaatgttaggcggcatgacaagtcaaatgcagtccaccagggtc

SEQ ID NO: 1705 - DNA, 34 bp, Artificial Sequence
  Affymetrix ID 2446212
atggccgacagtggacttagggaacctcaagagg

SEQ ID NO: 1706 - DNA, 25 bp, Artificial Sequence
  Affymetrix ID 2527475
ccatttgagatgttctccgaggtgg

SEQ ID NO: 1707 - DNA, 25 bp, Artificial Sequence
  Affymetrix ID 3110892
ttggtttcaaatggacagcagcaaa

SEQ ID NO: 1708 - DNA, 30 bp, Artificial Sequence
  Affymetrix ID 3229044
gatgtttctggtaatcatggacccttctcc

SEQ ID NO: 1709 - DNA, 381 bp, Artificial Sequence
  Affymetrix ID 3518549
caggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagta

SEQ ID NO: 1710 - DNA, 95 bp, Artificial Sequence
  Affymetrix ID 3701324
caaattacaattcaggttctgtttgaggtgctcctgagaagaggaaaagagtcagaaacctacacaaagatgtatagaagattaggtcctgagag

SEQ ID NO: 1711 - DNA, 255 bp, Artificial Sequence
  Affymetrix ID 2941831
ttgcgtttacatgacttgagtggcctgtcagtcccgctagtaaagtctcctcatccatccactctgtttaaacaatcaaactctgaaacctgtgtctcctggaccatcctataatccctaaaataggctgttatgcttttcacctctgccctactctgttagcactaccttacttattgacctctttcaatcaaatcgttatctaaaggatacctgtaactcagataggttgcctactgggcctgtttagtttta

SEQ ID NO: 1712 - DNA, 26 bp, Artificial Sequence
  Affymetrix ID 3403963
ttttttctgcactatggcttgggccc

SEQ ID NO: 1713 - DNA, 28 bp, Artificial Sequence
  Affymetrix ID 2337265
gaaaggcaacaacaagcagtcacagggg

SEQ ID NO: 1714 - DNA, 55 bp, Artificial Sequence
  Affymetrix ID 2774211
catcaggagtgtggattctgccattagtacccaacagatcaatgcccagtgtttc

SEQ ID NO: 1715 - DNA, 59 bp, Artificial Sequence
  Affymetrix ID 3626362
gcttcagaaaggggacgtctgttggataagcttgcagacttggtggaacgggacagggc

SEQ ID NO: 1716 - DNA, 553 bp, Artificial Sequence
  Affymetrix ID 3760869
gagcgtctctccttcaaatacctggatttttttttttttgtacactggttcatagatcggcacttgactttgaacctggcaccaaaaggcacaatatctgataccctgtacaagagctattagagatgctgccatatggatgggcaaaactgagccaatcccacttaggaatggaaggcttggacatggaagggaggatataaacgaggagttggagaaaaacgcaagcccagtttttgctagagtggaaatgaaagtgggaatgagggtcttgtttttagtcctctaaggaccaggaagcaattttaaaacttccttggtttttctgaaagcagcatattcaaaatgccagcaaaaactcctaacaactgcaaaaccaaaagaggatcaaagctcaccaacatcccttcttattgctgaaaggctctaaaattcaggatgccctgttcccttgtaaaagggaaaataattaagtctgatttatggtaatcataccacatcacacttctaaaaaaatattcaagtgtgtgaccaggggacgtttgacaccatt

SEQ ID NO: 1717 - DNA, 46 bp, Artificial Sequence
  Affymetrix ID 2772067
cctcaaagtgtctaggaggcggtttgatatgcagactaaagtgaga

SEQ ID NO: 1718 - DNA, 79 bp, Artificial Sequence
  Affymetrix ID 3350159
tttacatcatggtgtgtgacaaaacaattgcttccccctcctccctgcccttccccacccctgacttctaagataacta

SEQ ID NO: 1719 - DNA, 25 bp, Artificial Sequence
  Affymetrix ID 3946034
aggtctgcccatcccaaacctgggt

SEQ ID NO: 1720 - DNA, 453 bp, Artificial Sequence
  Affymetrix ID 2699092
gcttcaaacattggcccttcacgtacaacaaactctatcattcgatgtatcagggcgagcaaattcctacaacaacaacacagttaaagaaaatggattcagacctaccactatataaaactacacttgacctaagttactataattgtgcagaaaatgattattctgctgactaacaccgaatttaataccaaaaaagtaacctggagcatatgttaatgccttgtgcattaagagggtgtggggcagtgggagtagggaagtgggaggggatggaaaggtgagggagggtaggaaaccacaatacagcctcatagtaatatttaattttctaaatgtcacttattttccaaaagtaaaacattaaattataaatcacaactaattagaaagctgcaaatattgatatataaaatcagtaacttagagcctgcatgttattacagccatcta

SEQ ID NO: 1721 - DNA, 118 bp, Artificial Sequence
  Affymetrix ID 3027187
gttcacggcagctcccaacaggtctgaggtaagacgccgctattatcctcgtttgctgggagaagactcgggcttagagcctctgattacacagctgcactctaaccatttcctaata

SEQ ID NO: 1722 - DNA, 606 bp, Artificial Sequence
  Affymetrix ID 3496668
tctcatgtacctcgtagtatacctactatatacccagaaaaattaaaaattaaaaactaaagaaagaaataattgcaaaatgtaataatgtctttgaggggaaaataaaaacttcagtgaaatactctaagaggggtttgatgcagagctgggggatgtgggaaagtagagataggaaagttgaggagggagggatgggttacagtttgccaaggacagaattacttgagagggtgggagcaggacacacatgtcagggcctctggaacaggaagaggttggtttatggcagaaattgaaagaatgctctcatacacagctcactttcctccttgctttttgtctgcatagcattattcaatatgtagcataatataagttgaaatcatatatcacctttgtggtcttctcccaccagaaatcaggcattatgaaggcagaagggcagaggtatttgtcgtgtgtgtgtgtgtgtgtgtgtgtgtgtgtgtgtgtgtgtgtgtttgacttttgtatttttgctgccgtattcctggtacctggaatagcacttggcagacaaatgtatgcaaagttattcaaatccagtgggaccagaccacagtg

SEQ ID NO: 1723 - DNA, 26 bp, Artificial Sequence
  Affymetrix ID 3718614
cagtggggatgtagaatgtgtccaaa

SEQ ID NO: 1724 - DNA, 60 bp, Artificial Sequence
  Affymetrix ID 3759098
ggggcagcacaggtactctgattttggggccacgagggccaaatccgcgcctgcacgtag

SEQ ID NO: 1725 - DNA, 43 bp, Artificial Sequence
  Affymetrix ID 2721510
tattcctggactatagccgctgatctcattgatgcccttcttc

SEQ ID NO: 1726 - DNA, 79 bp, Artificial Sequence
  Affymetrix ID 2938424
ctcaagagtgaacccggaaaggctcctaaggaggtccctgcctcagtccaggcaaggctgtggcctagacgaggtggcg

SEQ ID NO: 1727 - DNA, 130 bp, Artificial Sequence
  Affymetrix ID 3606484
tgctgctgcccgcatgggatgcgcaggggaggcgtggggatccgcaggagggtggttgggatacaccggatacctctgctctcattgcttgtttgcaaatgctctatggacatttgtgtgctaaatccta

SEQ ID NO: 1728 - DNA, 110 bp, Artificial Sequence
  Affymetrix ID 3750237
ttcacccacatacaaaatagtgcgcgttttggctacttcagcctcttcccttctctagaaataactcctccttgtacttagtaaaggcacacattcacttcaagagtagg

SEQ ID NO: 1729 - DNA, 132 bp, Artificial Sequence
  Affymetrix ID 3320010
caggaggcccgaccaaaagcagatcaaataggagtgacagagttcagagctgcctgggacaaagttttaaattttattttcactgcaacccataggaagataaacattttatatcatgacccagcacacaca

SEQ ID NO: 1730 - DNA, 288 bp, Artificial Sequence
  Affymetrix ID 3907649
aggaatgggccgcatggactacctgggggtccccaaggccccagctcctctcctttccgcgccttctcccaacctttattgcagcgtctcctccggcgagacgaggccgggcttagaaaaagggcagcgaagacccaggggccaaactggcactgaggagctctggtctctgcgcggcggggcgccctctccgaatcagccccaacaggcgtggcctccgggcttcaggcagcggggtaaggggccaggacacgggcacagggtctgtatgtaaacggtgacagcggc

SEQ ID NO: 1731 - DNA, 70 bp, Artificial Sequence
  Affymetrix ID 2546923
ggctgtgtcacgtggacagtgtcacatctgcgggtggggataacaaggcacctgagtgcgtgaaggagga

SEQ ID NO: 1732 - DNA, 70 bp, Artificial Sequence
  Affymetrix ID 2788764
ccatgggaacagtcttgcagtgatggacggtttccatcccccatcactgacgcgggaataactgtgctgt

SEQ ID NO: 1733 - DNA, 35 bp, Artificial Sequence
  Affymetrix ID 2886332
cttttggcaaaaatgcgggccatggggtgtcaaag

SEQ ID NO: 1734 - DNA, 128 bp, Artificial Sequence
  Affymetrix ID 3307785
aacttcaaactgtgctcatgtgggcacagaagcatcgtgcagggctgcactgtcaccagccccagcagccacagggcagtttgtcaccagctccctgagaatcaactccagtgtgatggaggtgaccc

SEQ ID NO: 1735 - DNA, 70 bp, Artificial Sequence
  Affymetrix ID 2339825
tctttaagcgagaagtagatgtggggaggggttgttgcatttttaaagattcctgtattaggccgggtgc

SEQ ID NO: 1736 - DNA, 83 bp, Artificial Sequence
  Affymetrix ID 2922550
gtgaactttgtacttacgtgtgcttttgtggtagcaagtatcatctttctgtttccttttagcatttttggtgtactggtcta

SEQ ID NO: 1737 - DNA, 27 bp, Artificial Sequence
  Affymetrix ID 3319874
tagcgcacagtttgacatgtcaacaag

SEQ ID NO: 1738 - DNA, 254 bp, Artificial Sequence
  Affymetrix ID 3571362
tgggtactcgagcactgaagcattctcatcacttcccatgaagacactaatcccattaaactaggcattcctctttccctgaggttcgttgatagttgtatcttttgtcatttcccatagtgggaaaactaaggtccgtggagggggatgtgaatccataatttctcttcaacaaacaggcagcagagccattgtggaatttctagcctaagccataagatttgtggtttgtcctgatgtaagtgcattcactg

SEQ ID NO: 1739 - DNA, 137 bp, Artificial Sequence
  Affymetrix ID 2562256
acaggcgggtatggtaatagcaatctcaggagggctcttctgttgctgtgtagaaaatgaaccaagtagcatagaatcgtgaccagctttccacacctggctggagcactcctggggccttcagtagggacagttac

SEQ ID NO: 1740 - DNA, 61 bp, Artificial Sequence
  Affymetrix ID 2599272
ggaagttactgcttcccctggtgtctgttcttctggcttcagcttcgctggggatggattc

SEQ ID NO: 1741 - DNA, 152 bp, Artificial Sequence
  Affymetrix ID 3019543
gtggccttttaggaactgtagagtaacttaatataagagacattatttggtgggcagaattaagatcttgggagccattgctggtgcaatcctcacttgggaaaatttaacaaaatatagttagaccttttccaggtctcacccattccatt

SEQ ID NO: 1742 - DNA, 245 bp, Artificial Sequence
  Affymetrix ID 3316144
gagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaata

SEQ ID NO: 1743 - DNA, 93 bp, Artificial Sequence
  Affymetrix ID 3808909
gtctatgctccatcagcaagcactgccgactacaatagggactcgccaggctatccttcctccaaaccagcaaccagcactttccctagctcc

SEQ ID NO: 1744 - DNA, 135 bp, Artificial Sequence
  Affymetrix ID 2360953
acattctatcagagagtacatgatatcaccatgccttatcattggtgaagttaaccttgaacttggttaaggtgctgtctgccaggcctcttcactgtaaagttactgcttttccctcttcatactctgttcttt

SEQ ID NO: 1745 - DNA, 367 bp, Artificial Sequence
  Affymetrix ID 2458084
cagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaac

SEQ ID NO: 1746 - DNA, 68 bp, Artificial Sequence
  Affymetrix ID 2775432
tggagaccagataatggatgctggcaagatctgggaatcaaagccatggaaagggtgccattggtcag

SEQ ID NO: 1747 - DNA, 33 bp, Artificial Sequence
  Affymetrix ID 3577885
tagataatatgttaatggggtcaggagcttttg

SEQ ID NO: 1748 - DNA, 109 bp, Artificial Sequence
  Affymetrix ID 2413468
gctggaggatagttgcaagtattgtttggtcagtgctatttctacccatctgcaccacagtatttataattttcagcaggattgatttgtttcatcctatacagtggct

SEQ ID NO: 1749 - DNA, 39 bp, Artificial Sequence
  Affymetrix ID 2478883
tgaacagacctcaatgtcagacaagccaggggagcctgc

SEQ ID NO: 1750 - DNA, 28 bp, Artificial Sequence
  Affymetrix ID 2783808
atatttttaatggtgtcagccaggcaaa

SEQ ID NO: 1751 - DNA, 26 bp, Artificial Sequence
  Affymetrix ID 2406967
ctcctgtgactcagagccctcggctt

SEQ ID NO: 1752 - DNA, 282 bp, Artificial Sequence
  Affymetrix ID 2436718
tgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatgga

SEQ ID NO: 1753 - DNA, 191 bp, Artificial Sequence
  Affymetrix ID 2663594
ggcatcttatttcacgcaccacaggcccttgttcttcccagatgtcagcaggctttctccaataaatgcttcttcatttgctgttgcccttggaatcatcccagagattttaaacggctgtgtgtatgtttcatggggaagtctgtggcctccttacactgtcctgcagaactggcacctccggctgtttt

SEQ ID NO: 1754 - DNA, 541 bp, Artificial Sequence
  Affymetrix ID 2854791
tttagaattgactgaggagcggccgggtgcggaggctcacatctgtaatcccacacgccttgggaggctctgaggcgggtagatcacctgaggtcaggagtttgagaccagcctggccaacatggcgaaaccccgtctccactaaaaatacaaaaattagccaggtgcagtggcacacacctgtaatcccagctactccgaaggctgaggcaggaggatcacctgagcccaggaagttgagactgcagtgagctgagattgcaccactgcactccagcctcagtgacagcgagactgtctcaaaaaaagaaaaaagtgactgaggaggaagaggccaggtggcaaatggaacagaatcaccaaagggtgaacaggactaaggcaatgtagtgtatggctcagctacgtcagagtggaaaaggtgttattagagcagaaactatggtccctgcgtcacagggaagcaacctacagagaagcagcagctccccaagagaggagagataagaagccagaagcctcagagtgaacaattgtccta

SEQ ID NO: 1755 - DNA, 126 bp, Artificial Sequence
  Affymetrix ID 3350791
tcagagtttggtgtattagaggaactgccagttgttcatactggctaggcagggccttacatttgaggggagaagggtgagagattgagctgggtggaggaggacatgaaggcctttgggtgccat

SEQ ID NO: 1756 - DNA, 225 bp, Artificial Sequence
  Affymetrix ID 3447872
catcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcaga

SEQ ID NO: 1757 - DNA, 201 bp, Artificial Sequence
  Affymetrix ID 3709501
gtccagtgcctcataacatggtctcaagctcttaacaaatggagcccaggattcaaaaatctgaactctaataatggcttgtcattctggtttcttacccttgaggaacctgtgaggtgttaaccaacctgtaagctgcattccagcactggcaaacctggcctctcaaatatccagccaattctaagtttggtgccagga

SEQ ID NO: 1758 - DNA, 141 bp, Artificial Sequence
  Affymetrix ID 3606344
gaaaaaattgtcagttgcagggatacatttctcactaatgaagaaacatggaaaatatctgtgtaaggggatcacgctgtttcttaagttcagattattggaagagggtggtgatgtaggtgtgtactcttcctgaggttg

SEQ ID NO: 1759 - DNA, 203 bp, Artificial Sequence
  Affymetrix ID 3884906
ttctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactccc

SEQ ID NO: 1760 - DNA, 165 bp, Artificial Sequence
  Affymetrix ID 3919041
ttggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttctta

SEQ ID NO: 1761 - DNA, 314 bp, Artificial Sequence
  Affymetrix ID 2847683
ctgggaggctttcagatgcagcatccaccaaggaatacaccgactaacacacatgacagcctgaactagcaacctgcatcaacacccctgcagaaaagcagtgcatttcaactgctcatttaataagtatttgaattcataattacaaaacatcttctgtaattaaaccaccatatgcatttaaaatattttggggacaaagagtagcaaagaattatattggatattgactaaaaacacttatgaatatcaataatttgctcctcctcccttttcatcatagactctttacaatgatactgaccttggggttg

SEQ ID NO: 1762 - DNA, 75 bp, Artificial Sequence
  Affymetrix ID 3776975
tttgcaacccaacctgctggaagtgcaaagttcagaccagcagcaagaactcttgccccatgcttctgctgacat

SEQ ID NO: 1763 - DNA, 74 bp, Artificial Sequence
  Affymetrix ID 3543413
atctcgaaccagtggagcgcactcgtaacctggatcccagaaggtcgcgaaggcagtaccgtttcctcagcggc

SEQ ID NO: 1764 - DNA, 314 bp, Artificial Sequence
  Affymetrix ID 3653407
ttgagtgtggtagtgtccgtctgtagtcccagcaactcaggaggttggggcaggaggatcacttgagcccaggagttcaaggctgcagtgagctataattgcaccattgcactcaagctcaggcaacagagtgagaccttgtctcaaaaaaaaaaaaaaaaatttaaacaagcgacagtaatatttcattagaaatgtgatgaatgctatgaaggtgtagaggatgtctttagaatatataactgggagggagaccttttgagttaaggcaggtgctggtcaggaaagtcctgaggaagttacatttggattga

SEQ ID NO: 1765 - DNA, 79 bp, Artificial Sequence
  Affymetrix ID 3670580
gtgaaagactaaacagacgacttcaaaactctcatccaacatccaagagttctgccatttccaagattcagcaatcctc

SEQ ID NO: 1766 - DNA, 102 bp, Artificial Sequence
  Affymetrix ID 3767260
taccagttagtacaaagatcacagccaatatagaacctaaaagtattcacaatgaaaatgacaatgtagttgtcgttttgagctgcatggtacttaaatctg

SEQ ID NO: 1767 - DNA, 92 bp, Artificial Sequence
  Affymetrix ID 2456432
cacctgctccgagggtcagggctaagtggtttgagcaagtggcaagctcacaggtccagttggctgagggcctgacccatgacgatccattt

SEQ ID NO: 1768 - DNA, 74 bp, Artificial Sequence
  Affymetrix ID 2750681
tatgacactgaatacgggaaagtgatgggagtgaggctggttaaaatttttcacccacgcagtctccctgtgtt

SEQ ID NO: 1769 - DNA, 26 bp, Artificial Sequence
  Affymetrix ID 3071991
cacgtggtcactgacactcccatggc

SEQ ID NO: 1770 - DNA, 38 bp, Artificial Sequence
  Affymetrix ID 3436046
actcggatccgcaccaacaaattcaccgagggatttca

SEQ ID NO: 1771 - DNA, 190 bp, Artificial Sequence
  Affymetrix ID 2383133
tcagccctgtgaagatgtcattccattatcttctgtcttctattgtttctgtggagatggtagctctcagacaaattgttggttgctcgtttgtacatactccccactcccatcctgccctgggtactctaacattttttcactttgtgtttagtttcagcagttttaagataacgtgcctaggtcgggc

SEQ ID NO: 1772 - DNA, 25 bp, Artificial Sequence
  Affymetrix ID 2434773
actttccagccgcagagtagtgcag

SEQ ID NO: 1773 - DNA, 161 bp, Artificial Sequence
  Affymetrix ID 3338526
gtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaa

SEQ ID NO: 1774 - DNA, 46 bp, Artificial Sequence
  Affymetrix ID 3671856
caggcagacgcgagtgtctcggccatacaagatcagcgaatcatca

SEQ ID NO: 1775 - DNA, 659 bp, Artificial Sequence
  Affymetrix ID 3060641
ctcccatggctggataaaccaaatctgatacatccacatttaaggttgttttccaagttggtttccataaaaggcctttaacaataataggcttttaacaacaaaaaggtatccctcccatcacaatgagagcttgatgagggctcaaaagtgacttcaaaaactgtaaataattattttccttggacggctttaaaaacagctactgatagcaaatcagaaacactaaagaaaaaagacaataaggaaacagctgtttgtctagtgaatccataataaataccaatttgaggctatagattacaaagccaaaatattcttataggaaagttaatgtttatatttacaatcccatggactaaaaaaactgtctaatatcttaaagactgagtctacctttatttaacattgtttatacacaaagacccaagggatggtagaattcttgatccttctggacaaaagcatagtgagaggggactgaaattaacaaaaagggaaaattaacattaatctcaaaattctacccatcgttgtcttaaaatgatcaagactcagctacatctgagaaaaaggaaaaggatcagaagtgaaagaaatcagaagccagtaattaaaaaaatcataaccttgtgtgctttctactgacggcatttaaa

SEQ ID NO: 1776 - DNA, 744 bp, Artificial Sequence
  Affymetrix ID 3379623
ctgtgcctaggctgttgacaacttttgctgagttggacagaataagactgtgggccatgctgcttgcttcactctctgggtgtgatggatcggtgagggtgcagttgctatgattgtaattggtcatctcatcatggctgttaacatttctggaccaaacaaaaatgacttcagctacttccagattctgctgatacattacacaggatgatctaaaaggctacagttctgaagatactcatctttcttgtaatctgggggcatctggtcaatagtattgcctctgtgctgtattgtgtctagaacattcaaggacatttgatacttctcatactttaattgcgtgctctcccagttgcagcaccctctgaggcttctatgtgttgcagccgatgggcatttgcacagagcagcagtcatgacagcgttttcagggcagctatttctccttttcccccttttcctctcccccggcttcccattctcctcctcctccttcctcttctcgtcccctcctcctcctctttgttctcctccccctgctcttcttcctctctccttttcctccttctgtgtctatactagattattttcaatcagtcacatgtttttctttattttgaatgttacaaaatatttctctattgtaaacggtgtgccaggaaaaacatgagatgtgtatttgtattttttatgcacataattacttaatccaatgcctctccacttaattgggcctgatga

SEQ ID NO: 1777 - DNA, 30 bp, Artificial Sequence
  Affymetrix ID 3547548
ccagtgttgggtgcaaatatacctaggata

SEQ ID NO: 1778 - DNA, 77 bp, Artificial Sequence
  Affymetrix ID 2779848
atgagaagggtattggatacgattaggttagaagctcctagctcctcagtgaagtggtacataagggctctctctgc

SEQ ID NO: 1779 - DNA, 26 bp, Artificial Sequence
  Affymetrix ID 2869655
ttctttttctaccctcactgtcctct

SEQ ID NO: 1780 - DNA, 26 bp, Artificial Sequence
  Affymetrix ID 2964686
tctgagcacacctgtccagagagctc

SEQ ID NO: 1781 - DNA, 148 bp, Artificial Sequence
  Affymetrix ID 4004181
ccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatc

SEQ ID NO: 1782 - DNA, 30 bp, Artificial Sequence
  Affymetrix ID 2432028
atgtctaatggatatcgcactctgtcccag

SEQ ID NO: 1783 - DNA, 136 bp, Artificial Sequence
  Affymetrix ID 2443375
tactcaagatcaagaagataacggcaattataacacagggctgcaagtctctgtcctctgaaatgtatgtaaagagctataccatccactacagtgagcagggagtggaatggaaaccatacaggctgaaatcctc

SEQ ID NO: 1784 - DNA, 324 bp, Artificial Sequence
  Affymetrix ID 2736714
ttccagagtttgcagggacagttagagtcaatatgaattctcagaataagcactgccagatagtccggaagccctttacaaggaaagtgacatttttgctgtgttttgaatagtgaacaagaatgtgcaggaagagaatgaaaggatatcactagcagaagaaatgcctctttgtaaaaccatagaaaataactctgagttgccatataggacatatgagaatttcagtgttactgaaacaaaagcttttggaaaaggtatggtgattaaattgggtatacaatctgaaaggtaaattgaggacaacttgtgtgccagtttgca

SEQ ID NO: 1785 - DNA, 270 bp, Artificial Sequence
  Affymetrix ID 2969491
ttgtagctgttagaagggatagttctacaaggtatccaaatttcctaagtatatttctttaaattttccttttattgaattttctgtttactggcattagtctcatatcagttttggctacctttagctgcttttgttgaattctatttaataaaggcactgcaagtataaaattattaaaaatagacaagcacaatcctttctctgctaaacaagcttatgaaaaacctggtgatacccaaagagctacaaaggaaactctcacacttg

SEQ ID NO: 1786 - DNA, 94 bp, Artificial Sequence
  Affymetrix ID 3417650
ctgcacttgtggaacatcacatggcaaaaacaggagttttttcgctagactttttttttctttttaaccttattaaaaatgagattggtcctaa

SEQ ID NO: 1787 - DNA, 47 bp, Artificial Sequence
  Affymetrix ID 2586174
ctttgcttataatgttctgtagtgctgatggactgcctgattgtaga

SEQ ID NO: 1788 - DNA, 25 bp, Artificial Sequence
  Affymetrix ID 3777613
aatgctgcaggcatcagtgggagag

SEQ ID NO: 1789 - DNA, 137 bp, Artificial Sequence
  Affymetrix ID 3888166
tgacatcccgtcttcctatatggccttatttcctcatctccttcagccagtgctttgggaaagaacaggaaatattcctgctctagtgaggcttcttcaagcattcttagaacgcggttcaaacacaatagcaagtg

SEQ ID NO: 1790 - DNA, 32 bp, Artificial Sequence
  Affymetrix ID 2332174
tgaattctcaagaaacgtgctgggatggcaag

SEQ ID NO: 1791 - DNA, 92 bp, Artificial Sequence
  Affymetrix ID 2684865
agaaccaactacagtcacctctgctacctcagcatgggctggagcctttcatggaacagtagacatagtgcccagcgtgggattcgatacag

SEQ ID NO: 1792 - DNA, 484 bp, Artificial Sequence
  Affymetrix ID 2756426
aggcaatggcgattttaggctctccaggtgattacaatatgcaaccatgctcccaaatgtctgctgtaaaccaacatctttcggaggaccagttgaaaataatatttctcaaattaatgtgaaaagtgtttgctgttgagttgcggcctttcagtcccgcctttgttctctactcaccactgttgagttgtggcctttcagtcccgcctgtgttctctactcacctctactgcttgttttgctcctgattcaaaccagttccacacatactaagcccactgtgctaggtggcctgaccgtggtgaatattattgtggaggaaggactttgctgtaagaaattgcattccccaaaactgaaaccatgatatttactcaactgaggtaaaaaatgaaagactaagggggactcccaagggtcagggcaagaataaataccttggaatattaatacccatctcatgatgcctgagtgtaaatgctcc

SEQ ID NO: 1793 - DNA, 145 bp, Artificial Sequence
  Affymetrix ID 3309131
ggaaatgctaatttgagcttcattcataggggaacctactatatattgcatccctgctggttggaaattatcttcatctctggactgcattgtttagaaaaatgttaatggcttacaattctgagaactttattgtgtggctctg

SEQ ID NO: 1794 - DNA, 35 bp, Artificial Sequence
  Affymetrix ID 3435688
ctgacggatgagcagaagtcccgaatccaggccat

SEQ ID NO: 1795 - DNA, 29 bp, Artificial Sequence
  Affymetrix ID 3544550
tggaaagctttgaagacggcggttctggg

SEQ ID NO: 1796 - DNA, 134 bp, Artificial Sequence
  Affymetrix ID 3737293
tgaaggcattgtctgcatttccaagaagcacctagataaatacattccttacaagtacgtcatttataatggggaatcttttgagtatgagttcatttacaagcaccagcagaagaagggcgagtacgtcaacc

SEQ ID NO: 1797 - DNA, 25 bp, Artificial Sequence
  Affymetrix ID 2769855
ttagtttgggtctgatctttgtttc

SEQ ID NO: 1798 - DNA, 25 bp, Artificial Sequence
  Affymetrix ID 2914869
cttccttgtggaagttggcttgatg

SEQ ID NO: 1799 - DNA, 70 bp, Artificial Sequence
  Affymetrix ID 2754682
acagagcccgagcttttgtcctgcaggctcaagcttctagattcgtcttctcgttaatgcggggacggac

SEQ ID NO: 1800 - DNA, 80 bp, Artificial Sequence
  Affymetrix ID 2353146
ttccagcaggcaccgaaaaagccctgtgagcttctctctgagcggtggagaactgcacatgtatggatgttgctgcttcc

SEQ ID NO: 1801 - DNA, 66 bp, Artificial Sequence
  Affymetrix ID 2685210
atatttgagtgtcttattggacttggaacttccaccagtatctccagaattattgtctgtctgcag

SEQ ID NO: 1802 - DNA, 37 bp, Artificial Sequence
  Affymetrix ID 2774664
agttttggttccgacaagctgcaccattccaactgcc

SEQ ID NO: 1803 - DNA, 114 bp, Artificial Sequence
  Affymetrix ID 2517907
tacacaaattgaacgcggtagggtgggggaggaagtagggagataaagcctatgctgctgattcctcaattataggagcagtctctaaaagccctcgtcaatctagtgatgtgt

SEQ ID NO: 1804 - DNA, 30 bp, Artificial Sequence
  Affymetrix ID 3156168
gtgcaagctgtgtagtggatcattgagtgt

SEQ ID NO: 1805 - DNA, 106 bp, Artificial Sequence
  Affymetrix ID 3359979
ggactctttggaaccacaaataccacctctaatccttttggcagcacatctggctccctctttgggccaagtagttttacagctgctcctactgggactactatta

SEQ ID NO: 1806 - DNA, 118 bp, Artificial Sequence
  Affymetrix ID 3701355
tcaataaaagttgtattgagatgtgattcacatactgtacaatttatccctttaaaatatgcaattcggtagtttttagtgcattcacagagttgtgcagccattatcgtaatcagtt

SEQ ID NO: 1807 - DNA, 30 bp, Artificial Sequence
  Affymetrix ID 2329396
gtcagctagaaaccggtgcagagggaaaag

SEQ ID NO: 1808 - DNA, 251 bp, Artificial Sequence
  Affymetrix ID 3290788
tccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgc

SEQ ID NO: 1809 - DNA, 26 bp, Artificial Sequence
  Affymetrix ID 3449856
ctttgactccattgtctgctttggct

SEQ ID NO: 1810 - DNA, 25 bp, Artificial Sequence
  Affymetrix ID 3573894
aggggaaccagagcgcacaagggaa

SEQ ID NO: 1811 - DNA, 299 bp, Artificial Sequence
  Affymetrix ID 3670649
ccacgttgtcaagcacagaactataaaaacaatggattcagtgggtgaaggtaggagaaggggttcaagagattcagacttacagtaggaaagttatttttccaatctcagtaagttttttagggttatgaagattgagcactgacgacgctgaaataccacagtgcaaatgcttccgtagattccctgggctctgcactcaccagatccatttctatgataaagcacagagctcctcaaacagaacagtcgagttgcaggctcagcagcctccttgtcagtgtcctgctcaactcagc

SEQ ID NO: 1812 - DNA, 41 bp, Artificial Sequence
  Affymetrix ID 3851066
tgcagtgcctggatcataactctggatcatcactgaaacct

SEQ ID NO: 1813 - DNA, 26 bp, Artificial Sequence
  Affymetrix ID 3912092
tccttgggagacctggcaaaatgaat

SEQ ID NO: 1814 - DNA, 26 bp, Artificial Sequence
  Affymetrix ID 2626159
tctacttttaaatcaggcgtggcagc

SEQ ID NO: 1815 - DNA, 1205 bp, Artificial Sequence
  Affymetrix ID 3448099
caccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctctta

SEQ ID NO: 1816 - DNA, 507 bp, Artificial Sequence
  Affymetrix ID 3872452
agcacgagagactgctccctacagaagaaccttctgtgtggtgtgaatgtgggaaatcctctagcaaatatgacagcttcagtaatcatcaaggagttcacactagagaaaaaccttatacgtgtgggatatgtgggaaattatttaacagtaagtcccacctccttgtacaccagagaattcacactggagagaagccatatgagtgtgaggtttgtcagaaattttttaggcacaagtaccacctcattgcacaccagagagttcacactggagaaaggccatatgaatgcagtgattgtgggaagtcatttacccacagctctacattccgtgttcataagagagttcacactggtcagaagccttatgagtgcagtgaatgtgggaaatcttttgccgaaagctccagtctcactaaacacaggagagttcacactggagaaaagccttacgggtgcagtgaatgtgaaaaaaaatttaggcaaatctcttcacttcgtcatc

SEQ ID NO: 1817 - DNA, 25 bp, Artificial Sequence
  Affymetrix ID 2489627
gtgttctgcataagtggcttcctga

SEQ ID NO: 1818 - DNA, 29 bp, Artificial Sequence
  Affymetrix ID 2934111
tcaagattatatatggcagatgaggataa

SEQ ID NO: 1819 - DNA, 441 bp, Artificial Sequence
  Affymetrix ID 3181290
gtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaa

SEQ ID NO: 1820 - DNA, 28 bp, Artificial Sequence
  Affymetrix ID 3487237
aatgttccctgtgccaagttcacaagtg

SEQ ID NO: 1821 - DNA, 146 bp, Artificial Sequence
  Affymetrix ID 4009127
tgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacgga

SEQ ID NO: 1822 - DNA, 98 bp, Artificial Sequence
  Affymetrix ID 2750647
tgagtacagcccactgattgacattcaagacccattggaaaaatcaggagacacaagagtgggaagagtgcagattggagcagctatccaaaaataca

SEQ ID NO: 1823 - DNA, 1179 bp, Artificial Sequence
  Affymetrix ID 2916198
gggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagagagagataaaacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactc

SEQ ID NO: 1824 - DNA, 68 bp, Artificial Sequence
  Affymetrix ID 2984592
tggcttccgggcggcataaagctttttgcagtgttttataccctcggcaatcttgctgcgttagccag

SEQ ID NO: 1825 - DNA, 81 bp, Artificial Sequence
  Affymetrix ID 3123564
cagttcattccgtttccacctggcagctgctccctctgacacccaaggactcgcagggagtggccgttggacctgcagacc

SEQ ID NO: 1826 - DNA, 370 bp, Artificial Sequence
  Affymetrix ID 3165879
gtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatg

SEQ ID NO: 1827 - DNA, 73 bp, Artificial Sequence
  Affymetrix ID 3887555
tccattccaggattggtgctgaagcacatgtgtcctgaagttcaggacgtcagggtaattgacacagaagaaa

SEQ ID NO: 1828 - DNA, 182 bp, Artificial Sequence
  Affymetrix ID 2356740
tataatctagaaacattcttcagcgttttttttctttcattacatgaagagtcaagaccagtggttttgtggaatgcatgataatctgggttcttaaaaatcatttcttcttgattagatttcccattgtcttgaattgactcagtcagcctttcctcaccgctactccaggttcactaatg

SEQ ID NO: 1829 - DNA, 67 bp, Artificial Sequence
  Affymetrix ID 2665536
gagaatggataggcttttaggtcttggaagaaaagaagtgtccagggttcaatggagtggctgctct

SEQ ID NO: 1830 - DNA, 34 bp, Artificial Sequence
  Affymetrix ID 2833553
ttttggggatgacattgtggaaagtttaccctca

SEQ ID NO: 1831 - DNA, 37 bp, Artificial Sequence
  Affymetrix ID 3242698
tgtaatacctcatcatagatatttggggtgcccttca

SEQ ID NO: 1832 - DNA, 228 bp, Artificial Sequence
  Affymetrix ID 3911222
gaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggta

SEQ ID NO: 1833 - DNA, 25 bp, Artificial Sequence
  Affymetrix ID 2676501
attgaagaaccgctgctggagaact

SEQ ID NO: 1834 - DNA, 36 bp, Artificial Sequence
  Affymetrix ID 2839345
gcagccttattcagcaacgctggggatgacaacatg

SEQ ID NO: 1835 - DNA, 25 bp, Artificial Sequence
  Affymetrix ID 3239038
gaataagcagaaacggctgggcgtg

SEQ ID NO: 1836 - DNA, 105 bp, Artificial Sequence
  Affymetrix ID 3475695
cctcggaatgctgctcgaataagtgaaaagagaaaagagtatatggatgcctgtggagaagcaaacaatcagaatttccagcagcgataccacgcagaagaagta

SEQ ID NO: 1837 - DNA, 25 bp, Artificial Sequence
  Affymetrix ID 3563672
gttctgaggcccagcaactctgaga

SEQ ID NO: 1838 - DNA, 145 bp, Artificial Sequence
  Affymetrix ID 2333149
acctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctg

SEQ ID NO: 1839 - DNA, 29 bp, Artificial Sequence
  Affymetrix ID 3740914
ctggtgaggagccgcaactgggcatctcc

SEQ ID NO: 1840 - DNA, 34 bp, Artificial Sequence
  Affymetrix ID 3949524
ataaaacatctttgacgtgggagctgcagtactg

SEQ ID NO: 1841 - DNA, 32 bp, Artificial Sequence
  Affymetrix ID 2598329
cattgtctccaccaacaaacttgcatctggag

SEQ ID NO: 1842 - DNA, 47 bp, Artificial Sequence
  Affymetrix ID 2354732
gggtgtcatggaatcttaggagccctgcattccaattgcccaggctt

SEQ ID NO: 1843 - DNA, 28 bp, Artificial Sequence
  Affymetrix ID 2534399
cagaatgatggagtttgcatggcacagt

SEQ ID NO: 1844 - DNA, 2266 bp, Artificial Sequence
  Affymetrix ID 2677654
cagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgttgttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttcca

SEQ ID NO: 1845 - DNA, 34 bp, Artificial Sequence
  Affymetrix ID 2495347
agaaagtcttaatgggagagtgcccatggtatat

SEQ ID NO: 1846 - DNA, 126 bp, Artificial Sequence
  Affymetrix ID 3436411
caccatccttgaggggtcgagccaggactggaacctcagtccggccactacaacttcataaataccatcgccctgagatgctgaaatcccaggggccccccaccctcagaccaggtgccggtattg

SEQ ID NO: 1847 - DNA, 405 bp, Artificial Sequence
  Affymetrix ID 3630941
tccctggtatgtacacgcattcctgtgttttgtgaaaaaccgacaccatgctcctccctcactacatgtaaaacacttttattcattaaaaagaaaactgactggcttggacctacaaattagtttcattatttgttaatgtttgaaagccattaaaagatgaatattaaggtttctttatactcaatacttgtagttttgtttgggggaatgagaggatgcccttggtacctttgtgaggcctctccactgagggtcaatcatgacttctgttttaaaccagcccatcccatcttctccagctgctctccttatgtcttgcttctctcccctccaaccttctcagcataaggactcaatcctaggctcctaccccagacgggtgccttccaacgttcctggtgc

SEQ ID NO: 1848 - DNA, 208 bp, Artificial Sequence
  Affymetrix ID 3886257
cacttgggttggaaactctggcttctttccccccatggcctgtttggctcacaggtgccaccagcctcaccttgatccactgtcacttgtgcttactcggtgttagctgctttgcctcctttcagtccctcgaaccctgagctcttctcagagctcctagtgctcctctgtcggcctgcagtgcactcccgcttgtgcctattgtgta

SEQ ID NO: 1849 - DNA, 146 bp, Artificial Sequence
  Affymetrix ID 4004292
aggatgaattctcaccaaccatatattattttccgataacagtgtttggtagtgagggggatctattgctaggtaaaatacgatggattcaaggagcttactgtttgatgatagggcaagatgtgttcatggatactagattgaga

SEQ ID NO: 1850 - DNA, 440 bp, Artificial Sequence
  Affymetrix ID 2960481
ttggagccagtcaggcttttgtttagacattttaactttttcttgctttccttgcaaactcctcagccttcagactggttggaaagtaaatgtacaatcttacataaattttcaggtaatagcatttcagctttttccccaagattttttgcttgggaggagacagattagactggattcggagtcttgattttgcaaaggtaacaaaagacatgtttttttataagacttttcatcataagtttattttattcaacagaagcaaaatctaatataatggaaaaaataaagatctgtgataaatctgatctgtgtggataaacacaattagaaagacttaaagattaagtattgaaacaaactaccaaaatattttaatactgatttgtaaaaatttcagtacatttttcttctttgcttaattctactgggtcctgttt

SEQ ID NO: 1851 - DNA, 26 bp, Artificial Sequence
  Affymetrix ID 2977359
tagtcattggtgaagcaggattccaa

SEQ ID NO: 1852 - DNA, 34 bp, Artificial Sequence
  Affymetrix ID 3199214
tcaggcttctgttgcaagccaatgtagggaacca

SEQ ID NO: 1853 - DNA, 228 bp, Artificial Sequence
  Affymetrix ID 2743060
ttcctgagttcaagatatagttaagtttaaataataggacttgtgtatgaattggatggtgtgggagggaaatcaaaagttctgggccgggcgcagtggctcacgcctgtaatcccagcactttgggagtctgaggcgggcagatcacaaggtcaggagattgagaccatcctggctaacacgctgaaaccccatctctactaaagatacaacaaaatccgggcgtgg

SEQ ID NO: 1854 - DNA, 100 bp, Artificial Sequence
  Affymetrix ID 2811122
aggagttctccacatactctgcccaccctgatagcaactgaggtaggccagaaacttctcatgcactggttacctcctgagccatccacagaaagggtca

SEQ ID NO: 1855 - DNA, 28 bp, Artificial Sequence
  Affymetrix ID 3560070
gtgtgatcaaaaaagtggtcagtgtgaa

SEQ ID NO: 1856 - DNA, 47 bp, Artificial Sequence
  Affymetrix ID 2597541
acattgaaattcaagatgcaggcagagaaagaggacatagaccagat

SEQ ID NO: 1857 - DNA, 87 bp, Artificial Sequence
  Affymetrix ID 3747622
gcgcgtgctcaacttggatgggacacacctagtctttcttcaagtccctggattcaaagagcttcaaccgttcttgcaccgtcaggc

SEQ ID NO: 1858 - DNA, 26 bp, Artificial Sequence
  Affymetrix ID 2332216
ttgattcatcctatccgtgagcgtgg

SEQ ID NO: 1859 - DNA, 40 bp, Artificial Sequence
  Affymetrix ID 3029849
gctggcaccccagaagaagctagctcagcatgtgcgggtc

SEQ ID NO: 1860 - DNA, 27 bp, Artificial Sequence
  Affymetrix ID 3090304
atacattgatctctatttggtgctgga

SEQ ID NO: 1861 - DNA, 27 bp, Artificial Sequence
  Affymetrix ID 3441298
actatctgaaaatgggcaggtggtgca

SEQ ID NO: 1862 - DNA, 253 bp, Artificial Sequence
  Affymetrix ID 3584491
tgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaa

SEQ ID NO: 1863 - DNA, 52 bp, Artificial Sequence
  Affymetrix ID 2775809
gtaaactttgaggatgattctcgtggaaaataccttgaacttctaggataca

SEQ ID NO: 1864 - DNA, 72 bp, Artificial Sequence
  Affymetrix ID 3380586
tttcgatacaagaagcgggtgtataaacaagccagtctcgatgagaaacagttggccaagctccacacgaag

SEQ ID NO: 1865 - DNA, 277 bp, Artificial Sequence
  Affymetrix ID 3410510
tgtgtcccgcagctcaatcagacttctggatgccatcaaggaggtctgcatgacctaaggatcattgttctttgaaaggaaaacaagttcattaatcttactggctgccagggttaggatgcaaagttaatcaattattagtgactaccgtctaccgaatgactacgtgcaagcagtcatgcatggaggaagaaaaggacaaagagaaaggaaaataagtaaaaaacaaacgtttaatgattttgataatataggctcagttacatcaccacaaaca

SEQ ID NO: 1866 - DNA, 32 bp, Artificial Sequence
  Affymetrix ID 3266758
gttctggaactcttcacacctgtgacctgcat

SEQ ID NO: 1867 - DNA, 32 bp, Artificial Sequence
  Affymetrix ID 3878506
gaaactggagcacccatcctaactgatgatgt

SEQ ID NO: 1868 - DNA, 163 bp, Artificial Sequence
  Affymetrix ID 3189392
tgcaagattcttggatcctcgtccggtacattttggctgcattttatgtgacgtttgtgagggggttagaaatactttaaaatttcagggaacttgaataacaatgaaagatgtgcagctagtccaaacagatggacttcagtagcaattccaggggcgtttc

SEQ ID NO: 1869 - DNA, 42 bp, Artificial Sequence
  Affymetrix ID 3737624
ctccctgcagaagcgtcccgacggccacatcgtgagtgtgag

SEQ ID NO: 1870 - DNA, 149 bp, Artificial Sequence
  Affymetrix ID 2587558
tagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatga

SEQ ID NO: 1871 - DNA, 109 bp, Artificial Sequence
  Affymetrix ID 2636399
gccctacgtggtgtcgggctacagcggtcgcgtgtacgagaggcccgtggcaggtccttatatcaccttcacggatgcggtcaatgagaccaccatcatgctcaagtgg

SEQ ID NO: 1872 - DNA, 455 bp, Artificial Sequence
  Affymetrix ID 3383004
aactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaa

SEQ ID NO: 1873 - DNA, 89 bp, Artificial Sequence
  Affymetrix ID 3959450
tgtttttatcacagggccgtcgttgaagcatgtatgactatgtgtgtgaaaatgttctgcaaaccaaaaagggctcaggtgctataatt

SEQ ID NO: 1874 - DNA, 84 bp, Artificial Sequence
  Affymetrix ID 3984482
gatgagatgccacgcactaccattcatcactagtggcacttacacctgcacaaatggagtgcttcttgactctcgctgtgacta

SEQ ID NO: 1875 - DNA, 53 bp, Artificial Sequence
  Affymetrix ID 2333884
ttgtagagtatgaacactcctttactttcagcaacgtcggcatctccaaataa

SEQ ID NO: 1876 - DNA, 27 bp, Artificial Sequence
  Affymetrix ID 3392870
atgcatgagggcacgcctcctactttc

SEQ ID NO: 1877 - DNA, 30 bp, Artificial Sequence
  Affymetrix ID 2395894
gccgcgcggtttcccttcgcagatgtgtat

SEQ ID NO: 1878 - DNA, 83 bp, Artificial Sequence
  Affymetrix ID 2701311
attgagcctgcccatcatgcattgcaacaggaaggtggatttgaaaagggaaaagaattaaaacatcccatcacacgtgtaat

SEQ ID NO: 1879 - DNA, 252 bp, Artificial Sequence
  Affymetrix ID 2976681
cagatacgggtgtgtacttgaatcaaggagaggcagtagagcagccttatgttttgttccccaaagagtgagatgtgtacccaattcttgcacatagtgaagaagctgttctcttttttgttgtttgtcacatctgattattcatggagaaagttgcagcttggggctagtaaaatttttttttaacaccgttctcatattatttgctctcttcttttaataaaggacagataggccttgatgtggctgtaa

SEQ ID NO: 1880 - DNA, 154 bp, Artificial Sequence
  Affymetrix ID 3398768
gcaactttcagtggaggcgctgagagcaaattgcagcagagatgcgctcagggtgcagtaacaaggaaggacccgctctccgtgtcagtggcctgcaggggaagtgagaaccgggctcatgctgggctcctctactttgcagggtttaaggccg

SEQ ID NO: 1881 - DNA, 39 bp, Artificial Sequence
  Affymetrix ID 2376766
actacagcatgaaggaattttccgggtgtcaggatccca

SEQ ID NO: 1882 - DNA, 29 bp, Artificial Sequence
  Affymetrix ID 2648351
ggagcagcttcaatcaaaaggcggggctt

SEQ ID NO: 1883 - DNA, 41 bp, Artificial Sequence
  Affymetrix ID 2855376
ccttttctgggggatcctaggcagaagcgatggcaggacaa

SEQ ID NO: 1884 - DNA, 28 bp, Artificial Sequence
  Affymetrix ID 3715585
aatcaccatgacaggcagagtgtgggca

SEQ ID NO: 1885 - DNA, 31 bp, Artificial Sequence
  Affymetrix ID 2432021
agtttagttctcttacgtgtggctagccaat

SEQ ID NO: 1886 - DNA, 25 bp, Artificial Sequence
  Affymetrix ID 2527209
tttttataatgtgtctaggctgggt

SEQ ID NO: 1887 - DNA, 25 bp, Artificial Sequence
  Affymetrix ID 3753258
ttgagctgcccaagccacctagagg

SEQ ID NO: 1888 - DNA, 64 bp, Artificial Sequence
  Affymetrix ID 2607727
gctgtgcgaatggactcagctgcccgaactcacagaatatcagtaacagcaccgaaacttcaca

SEQ ID NO: 1889 - DNA, 63 bp, Artificial Sequence
  Affymetrix ID 2970557
gctgtcaattttccaatgagagatggtatagatgatgagtcatatgggcagatatttaagcct

SEQ ID NO: 1890 - DNA, 26 bp, Artificial Sequence
  Affymetrix ID 3233715
ccttctgcaaatggggatgagtcctc

SEQ ID NO: 1891 - DNA, 26 bp, Artificial Sequence
  Affymetrix ID 2555212
catgctgcatggttgctggtaaaaca

SEQ ID NO: 1892 - DNA, 103 bp, Artificial Sequence
  Affymetrix ID 2601671
tatcctggtggagcagctatacatgtgtgtggagtttctctggaagtctgagcgatatgaactcattgctgatgtcaacaagcccatcattgctgtctttgag

SEQ ID NO: 1893 - DNA, 161 bp, Artificial Sequence
  Affymetrix ID 3630677
tgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatcttta

SEQ ID NO: 1894 - DNA, 98 bp, Artificial Sequence
  Affymetrix ID 2677724
ggcgccatcagccacttttagaagccatcagccagtgtgttgggaaaagaggtttgtcaagtgttggcctatgggaaggtggtcaatgaatgttttga

SEQ ID NO: 1895 - DNA, 33 bp, Artificial Sequence
  Affymetrix ID 2898386
tggaggcatttaatggcgatgtgcaggtgcaag

SEQ ID NO: 1896 - DNA, 127 bp, Artificial Sequence
  Affymetrix ID 3412766
catccacctcgaaagctgggcattaacgatattgaaggacagcgggtacttcagattgcagtgattttgagaaatctttcctttgaggagggcaatgttaagctcttggcagctaatcgtacctgtc

SEQ ID NO: 1897 - DNA, 38 bp, Artificial Sequence
  Affymetrix ID 3975856
tggaatgtacctggaatagggaagtggacagtgagggc

SEQ ID NO: 1898 - DNA, 180 bp, Artificial Sequence
  Affymetrix ID 2466297
ccaggtcgcacatcagctgcaggcacagccagttcatgggtagacagccacatcctgccccaggaggagggcagccagcatgggcgatgcaagctcccctcgtctggaaccagcacaacctcaggcactcgagccttggcccctcacaagcaacgtcctcaatgggtggcgttcgttcat

SEQ ID NO: 1899 - DNA, 205 bp, Artificial Sequence
  Affymetrix ID 3240817
tccatcgattgactgcgaggggctagggttcacagcaagcagaacgtcctgggtttctcttcaataccacctcctcctctcctgttcagatgctgagaaacatctggcgcagtagagatgctgcctctgacatttctatgacaaaacgcgtgcctgtgctagggtttgcacaggcacaagttatcacaacctcgggatggggctg

SEQ ID NO: 1900 - DNA, 83 bp, Artificial Sequence
  Affymetrix ID 3454311
catcacttggtcaccattgggcttatctccttctcctacatcaacaatatggttcgagtgggaactctgatcatgtgtctaca

SEQ ID NO: 1901 - DNA, 98 bp, Artificial Sequence
  Affymetrix ID 2437092
gggagtgggtctcaaatatagagggggtagcaaggtggaaggggcccttccaccttttgtgggcactcaagttcggacctctgggatcggcgattccc

SEQ ID NO: 1902 - DNA, 336 bp, Artificial Sequence
  Affymetrix ID 2683293
catctgtgcttgacgcagaggcctccggggtcgcgagcttcggaggtggaggtgccccgtcttcgggttcccacgccgccctggcgacctggggctccagccccaccgcggactccggtgggacgtgggtggcgcaagcacaccttgcccctgtgactcagcttgagggggcccaagctgtcccactgagcacgcgcccagcaggccgtcgcgctgcgggtcctggtcctcctgtcatttactggggtgcggaggcctccgaggagtctgagggtgggacagtcccacttccggaggagctagggcagggaacacaaagtcccgagtgccggggca

SEQ ID NO: 1903 - DNA, 92 bp, Artificial Sequence
  Affymetrix ID 3701415
ccataaaattcgcatggtgaaatgcacgtaacataaaatttaccatcttaaccatttaaatgcacagttcagtggtatcagatacattaata

SEQ ID NO: 1904 - DNA, 41 bp, Artificial Sequence
  Affymetrix ID 2590322
ctagaattaagatatgctgatgagttgcttctgcagttcat

SEQ ID NO: 1905 - DNA, 174 bp, Artificial Sequence
  Affymetrix ID 2973489
tttggcgtttgctacagaatggtgaatttatgtatttctcttccactttgacatggacattgcctcattcttcagtagtgtgcatattcaccttaatttattcaaaagctattttacctttttcaataacaccacatcaattaccttaacttattcacttacatcagtcttccc

SEQ ID NO: 1906 - DNA, 25 bp, Artificial Sequence
  Affymetrix ID 3020769
ggatgcaggactgagtcatgccact

SEQ ID NO: 1907 - DNA, 124 bp, Artificial Sequence
  Affymetrix ID 2807755
gagtagatgtaactaagaggtttgagaaaggaatttcagcagagttattgaaggagaagtcaaggagaggagaaggagaggagcagtgaatgttgtcgtgaagaggtgttgtcttgaaatactg

SEQ ID NO: 1908 - DNA, 44 bp, Artificial Sequence
  Affymetrix ID 2918704
ctctggagtggatagggttaatccgggcagccagaaactcccag

SEQ ID NO: 1909 - DNA, 28 bp, Artificial Sequence
  Affymetrix ID 3024096
taacaatatgtgcaggcaggaccgaaaa

SEQ ID NO: 1910 - DNA, 225 bp, Artificial Sequence
  Affymetrix ID 3270274
gggcgctttcccactgttctagacgtaggagagaaagcacttctcagatggtgagcttttatcttccaatcttgtcaaccgaggagacctggaagttccctttcaacctggaatgtgagccctgcttgctgggcacgagataaggaccaaggattgacccaggacaatttcagagagcacaggggtggcatatcctcatgtcagggcgtggagctaatattcaga

SEQ ID NO: 1911 - DNA, 30 bp, Artificial Sequence
  Affymetrix ID 3356025
atggcccagaatgggttgtcagtgctccag

SEQ ID NO: 1912 - DNA, 227 bp, Artificial Sequence
  Affymetrix ID 3913713
ggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgtta

SEQ ID NO: 1913 - DNA, 355 bp, Artificial Sequence
  Affymetrix ID 3506761
tgtagtgttgctgtatcttccatcgtacagtggaatggcatcttacagaaggggtttcggtcctatggttagcttaatgttgaagtcagggaaagtcaaaatcaccattggaactcccttcaactgtctataaaatacactatgcacagtaccttggtttacgtatatttgcataaatacatactttgtatagtcacatgttgtatgacaacttactgagttgttcgatgaacaactctatgtgctaataataattttgatgtattaaaatgggaaagcatttgcttaactgagtggagaggcacaggttgctgagtcagacgtatctcctgttgcacacgtaccttcaggatgg

SEQ ID NO: 1914 - DNA, 26 bp, Artificial Sequence
  Affymetrix ID 3888725
gcagatcgacaagtccgggagctggg

SEQ ID NO: 1915 - DNA, 211 bp, Artificial Sequence
  Affymetrix ID 3357756
tctgtccagagtgcaaggccgaaccagaggacacacatgatcatttctattttagaaacacgcctggggcagagaggacagcaggtgaaagagactgagagagaacagtcagaggctagtactggccaagacaggagagtgagggagcaaccgtaatgaggatggatgaataatttgagagagatttaggggtaacgaaccagactcactc

SEQ ID NO: 1916 - DNA, 29 bp, Artificial Sequence
  Affymetrix ID 2371244
atgagctcaccttgcctgcaactgtctct

SEQ ID NO: 1917 - DNA, 313 bp, Artificial Sequence
  Affymetrix ID 2660674
tgcccatttttctacggcttgttgatttcttgggagttccttgtaagctttatagtctctgtaattaatgagttccaaacatttttcctagtttgtcttttgtcttttgtttttggtgtggtgtgtcaaacagaactgtttttttgttgttgttcttacatagtttaatttttaatgcttctgtattctaaatcatagccaaaaatgacgttcccatgcaaaggaatgtctcatgttttctttggatacttgctgtggtttcattacttttccgtggaaagctctgatccttgtgcagttgatcctgatataa

SEQ ID NO: 1918 - DNA, 27 bp, Artificial Sequence
  Affymetrix ID 3199144
tagaatgtttgtatattgctgcctggc

SEQ ID NO: 1919 - DNA, 25 bp, Artificial Sequence
  Affymetrix ID 2411720
agatccaattagagccagggtcagg

SEQ ID NO: 1920 - DNA, 185 bp, Artificial Sequence
  Affymetrix ID 2682075
tgataatagggacgttgtcagacccttaactaagccacacactgctgggagcctccggaataactttaatgtagttgtagggaagggagtcgttggcagggatgaggatccctgcttgactgctctctttcctgacgaggaagaaaaggacagtgatcaagcacagggtctcaaaggaggtctta

SEQ ID NO: 1921 - DNA, 25 bp, Artificial Sequence
  Affymetrix ID 2709855
ggacagcattacggtggacagtgaa

SEQ ID NO: 1922 - DNA, 121 bp, Artificial Sequence
  Affymetrix ID 3016026
ctgcaaaacgggtacagcattcctgtatgatagctcacgccgtcgttgtgaaaaccacatagacttggtcaattctcggtcctactctgccctcccgtctcagccctcgtgttgccattgc

SEQ ID NO: 1923 - DNA, 28 bp, Artificial Sequence
  Affymetrix ID 3550736
accactacttcatgcagggcagtgtgcc

SEQ ID NO: 1924 - DNA, 133 bp, Artificial Sequence
  Affymetrix ID 3059100
ggaagctaccaaggagactattaaagaaattcaggatggtgaagacagcttaaagggaaacagttctgcaaatagaggcgatgggagatataggaaagagggactatgtgtaggtcttgttgcgtcgctgaag

SEQ ID NO: 1925 - DNA, 40 bp, Artificial Sequence
  Affymetrix ID 3379723
tggttggggcagacaacttcacgctgcttggcaagccact

SEQ ID NO: 1926 - DNA, 282 bp, Artificial Sequence
  Affymetrix ID 3432355
cgtcgtggatggatcagttttgctcgatagagggacatgtttttctgtggcaacaggagggcaaaaggagaaggtggccacagatgccggtagatgagctgagagtgattgtattccctatcctctcggaagcttgaggcaaggccatcaacagacaatcagagggaataagaagagatagaatatatgaagaaagggagaaaagatgaaatcgtaattgtgtagcagggcaagaagtccagaaatttctgtgctgtgccaagttcccagttgaggcggtga

SEQ ID NO: 1927 - DNA, 301 bp, Artificial Sequence
  Affymetrix ID 3511352
ctgacggtttaagatgctgcattttaagtaatgctgagttgtatttttatttcagtcattcatttctacttattttgagcacccattatatgttaggttccatgctaggcactgtaaagataaagatgagaaagactcagcccttacctaaaggagtatagagcctagttggggagacaggaggcagatagttacagcatggagagcaaattctctgagggaggaatgaagtgagataagagcacagaagaaagacccggggatcagagcagacttcctggaggaggcaatcattgacttg

SEQ ID NO: 1928 - DNA, 137 bp, Artificial Sequence
  Affymetrix ID 2627501
tcctgcttgtgaacagattcctatttccgtgaggaggtgacctcgaagaagagcagcttctattctgctgggaggtgtactgccttctggtatcaggcttctgcatcccgggaaagctcgggataacctgaggcacc

SEQ ID NO: 1929 - DNA, 30 bp, Artificial Sequence
  Affymetrix ID 3608077
agaccacaatgagggacatggcaagttcct

SEQ ID NO: 1930 - DNA, 25 bp, Artificial Sequence
  Affymetrix ID 2393810
ttgaggaaaattgctctgtccctat

SEQ ID NO: 1931 - DNA, 83 bp, Artificial Sequence
  Affymetrix ID 2506539
tccatttaaatgagagggtggagctgtccttgcaaaccaatgatgcagctgatgccatgcagtggatcttccttccccctaaa

SEQ ID NO: 1932 - DNA, 42 bp, Artificial Sequence
  Affymetrix ID 3068053
tttcccagagctctaccttgttgtcagcactccctgcaatag

SEQ ID NO: 1933 - DNA, 90 bp, Artificial Sequence
  Affymetrix ID 3762439
ctaagagagttactgaccctaactcccctaaaacctaactatcaaaagcctaccactgactggaagccttacaataacactaacagttgg

SEQ ID NO: 1934 - DNA, 341 bp, Artificial Sequence
  Affymetrix ID 3896232
tcagtctgcgatgaaggtgaacccatcttataaagcagagcttacttacattctgcaggattttggtgtggatgcatagaaggcttacctggttagtaagcctccattcctccgacctacagaaggcaacccttctgcagctccaagcagggatttctagaaaagaccaggtgtacaaaacatctaagctgtgcctcccaccacaggtggggaagtcccctgatttggtcagacacagatgaatgtctgtgtctgactgagcccagaaacagttcaattgatgggggctggaaccaccaagaaaacactcctgacctgggcaacactgtcttccagattat

SEQ ID NO: 1935 - DNA, 91 bp, Artificial Sequence
  Affymetrix ID 3916144
tgtgtgtacctgagataagatgatgtcttgtccaatgctggtttccaccttgtgccctgagctgttgggagaggctcctgcgacctgtgac

SEQ ID NO: 1936 - DNA, 235 bp, Artificial Sequence
  Affymetrix ID 2389578
ggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttg

SEQ ID NO: 1937 - DNA, 98 bp, Artificial Sequence
  Affymetrix ID 3290995
agcgggctaacaccactgcatgtagctgcacattacgataatcagaaagtggcccttctgcttttggaccaaggagcctcacctcacgcagccgcaaa

SEQ ID NO: 1938 - DNA, 468 bp, Artificial Sequence
  Affymetrix ID 3403153
tgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatc

SEQ ID NO: 1939 - DNA, 133 bp, Artificial Sequence
  Affymetrix ID 3439875
acctggctttggttattgatgagaagagtaattaatagaacattccctttgctgtgataccctacccaaaatagctcggttgttggttcactttcttcagatacctccttgtctcatggaccgcctacttact

SEQ ID NO: 1940 - DNA, 233 bp, Artificial Sequence
  Affymetrix ID 3568358
tcatgggtttccaaatatgggatgcaatttcaagttcttaacaccaaatataaccctacttgttttagtttcctggcattcatcctatcatccccagtttactgcacctcaggttatcaaggatgtgggagggattctacaagggtatgttcccccagagctttttggtaccctgcaatcccagaagttgttgatgctaggatgtctggagagcactggccatttattactga

SEQ ID NO: 1941 - DNA, 37 bp, Artificial Sequence
  Affymetrix ID 3701322
tgacgtgaatcacgctacactggcggagaacgggctc

SEQ ID NO: 1942 - DNA, 28 bp, Artificial Sequence
  Affymetrix ID 2975832
gccatgatcgtagcactatactctagcc

SEQ ID NO: 1943 - DNA, 315 bp, Artificial Sequence
  Affymetrix ID 3072788
gtctaattcagaacccggtgggctctccatgcattattggcagcacttttatccaggggcacagacagggaatagggttactggaaacagggagtgtagctcaaggaattgttctctctctggagtggataagttgtttgacctactgactcatttcataggaattaggaaaacaacctagtgtggtttttattgttagtcctggaggattccaaaatctgtgtgcctgcaaataagatgagctggggaaagggagcaccagcatttggtgtttctacttgcctcttttcctgatggaatccaatcctctgcttc

SEQ ID NO: 1944 - DNA, 673 bp, Artificial Sequence
  Affymetrix ID 3380982
gctgtttcagtccacaccttgttcacagtaagatattcaattcaattcagcaaacatttgttgagtgcttgctgctctgtgcctgaccagaagaaatgaagccaagatacaaataatagaaccctgtcatgagcacagaaagacctgctgagtttctattgattgtggtaaaccagcctgcatccagttccaagtaacagctgcccacttagtgaatactctctcatgtttcaacactcagttctagtgtagcctcttctataaagcctttcttttccagataaaattggttaatgtgtcctgtgttaggctgattgttttgatgatccctattcatggtctcccctgtatccatctctttttgcctataacattgtagtcccatctcactctgatgctgggaccagacatgtgacttgttttagccaatgagatgtcgataaacatgaagcaaacagaagctttaaaggaggcctgccctcttgctctttgccagtgccatgagaacatggctgatcagctggagggttatgagatgtgtaggtgagagacatgcaaaagagccagagataccagctgaagccatcctagactagcccacagtcagcctacccccagtcaagatcaggagagtcacccaacccacagatgactgccgacacatgagtaagcc

SEQ ID NO: 1945 - DNA, 28 bp, Artificial Sequence
  Affymetrix ID 3902033
attccacgcgtcaaattgtgggcagtga

SEQ ID NO: 1946 - DNA, 25 bp, Artificial Sequence
  Affymetrix ID 3952107
acaggcacaggggagtcaagcttag

SEQ ID NO: 1947 - DNA, 25 bp, Artificial Sequence
  Affymetrix ID 2678585
agcacccagtctctgttctcagagg

SEQ ID NO: 1948 - DNA, 168 bp, Artificial Sequence
  Affymetrix ID 3463862
tctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgcta

SEQ ID NO: 1949 - DNA, 27 bp, Artificial Sequence
  Affymetrix ID 3727958
caccatcttctcggatggatggcaaag

SEQ ID NO: 1950 - DNA, 38 bp, Artificial Sequence
  Affymetrix ID 3974043
agcaagccagtgcagtccttggtcacagtcactcacag

SEQ ID NO: 1951 - DNA, 33 bp, Artificial Sequence
  Affymetrix ID 3982214
ccaaaaccaatgtgtctaaggtgcggcatcttg

SEQ ID NO: 1952 - DNA, 26 bp, Artificial Sequence
  Affymetrix ID 2685843
gcggtggtccaatcatagttcactat

SEQ ID NO: 1953 - DNA, 25 bp, Artificial Sequence
  Affymetrix ID 2686522
ccagacatgccaccaactaaatccg

SEQ ID NO: 1954 - DNA, 25 bp, Artificial Sequence
  Affymetrix ID 4014220
cttcctctgtagctgccagacctgc

SEQ ID NO: 1955 - DNA, 26 bp, Artificial Sequence
  Affymetrix ID 2838069
aatggccatcaatgactgcagcaaag

SEQ ID NO: 1956 - DNA, 281 bp, Artificial Sequence
  Affymetrix ID 3701416
cgcatctggcctataccagtgtatgttttctttaggaaaaaataaggcagaaaccagaaaactaacacttcacataaatgtaggtgcagaatattggtacgatattggataacttaaattgctgaactgtatgaaacttaatttttctaaggcaaaaattgatatcattggaaggatcttggagtcagtggcaggcaaacaaaatttaaacttggctgcattttcttttttcgtttcaaatgaatacttaactaggtgcaatggctttatttgtggtcttc

SEQ ID NO: 1957 - DNA, 243 bp, Artificial Sequence
  Affymetrix ID 3756107
tgaattcacagtgttgtatcccatgtagggaaaaataagactaattttccccccacactctaacacactgtaattttgcacttggaactttgctaatctactgtccaacctccttctcaacaaagtcaaatcaaaggagaattaacctagaagaggggacaataaaataagaggtcctcagggagagggagaaccaaggaaatagaatctacttaaatctggccagatagcacctcgtggatt

SEQ ID NO: 1958 - DNA, 66 bp, Artificial Sequence
  Affymetrix ID 2382147
atgacaggctgcccaccaaggacggggagctgctctttgtgcattcagccgaagggagcgagttct

SEQ ID NO: 1959 - DNA, 89 bp, Artificial Sequence
  Affymetrix ID 2590022
agagaaacacatcactagattgacgagggcttttagagactgctcctataattgaggaatcagcagcataggctttatctccctacttc

SEQ ID NO: 1960 - DNA, 26 bp, Artificial Sequence
  Affymetrix ID 3831701
gtattggcgactgcctgtgcatacac

SEQ ID NO: 1961 - DNA, 59 bp, Artificial Sequence
  Affymetrix ID 2792492
ctgactgtgaattagagtttgcgctattggaaggtggaacccactgtgctcattgtata

SEQ ID NO: 1962 - DNA, 252 bp, Artificial Sequence
  Affymetrix ID 3289301
gcatttactagtgctgtgtgcctcgttgcttttctgggtagtgtttggtgatgggcatagtgtggagtggtggtagagtacacagtgtgattctgtctggtaaggaagctgtatgttgatgttcactgatgtgaataggttcatacagtcccttaggcatttggctggaggataaagaacagccattgaccagcagagtactttttttgaagtttatgcaagacagcgtgctaggtactactgccagcttga

SEQ ID NO: 1963 - DNA, 74 bp, Artificial Sequence
  Affymetrix ID 3686344
gtcctttctccagcccgacatccacctttttaaacaaaatctcttctacttggagactctcaacaccaagcaga

SEQ ID NO: 1964 - DNA, 266 bp, Artificial Sequence
  Affymetrix ID 2596800
tgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaag

SEQ ID NO: 1965 - DNA, 54 bp, Artificial Sequence
  Affymetrix ID 2614940
ctgctccattggagacttcctgagggcaacagacaaactatttgatagctgaat

SEQ ID NO: 1966 - DNA, 76 bp, Artificial Sequence
  Affymetrix ID 3988991
tcattttgggtatcactggagtctgatggaaagagataggcgcatctctggagttgatcgttactatgtgtcaaag

SEQ ID NO: 1967 - DNA, 81 bp, Artificial Sequence
  Affymetrix ID 3068834
tcatataatagacagtgcggttgcaccttgtgttcatgtactgatagctgttaagggtgcagtgatgaaccaacagagctc

SEQ ID NO: 1968 - DNA, 26 bp, Artificial Sequence
  Affymetrix ID 3116499
gcctctctgttctcatgggctacatg

SEQ ID NO: 1969 - DNA, 101 bp, Artificial Sequence
  Affymetrix ID 3227229
ccaacctgaacgaaatgaatgattacgcagggcagcatgaagttatctccgagaacatggcatcacagatcattgtggacttggcacgctatgttcaggaa

SEQ ID NO: 1970 - DNA, 52 bp, Artificial Sequence
  Affymetrix ID 3777767
tgtgtttggggtgattagagcttcttgcaagcttagaagtaggaagctaatg

SEQ ID NO: 1971 - DNA, 25 bp, Artificial Sequence
  Affymetrix ID 3950135
cactggcacaggacgaccctgaagg

SEQ ID NO: 1972 - DNA, 134 bp, Artificial Sequence
  Affymetrix ID 3425446
gcatgtcttgctactacttcatagatgtcataagacccgtttatggattagagttggtgtagaaagccattgccttgagttgaaaaatgaatactgtaaaagctcaatacaaatcctccaaagcacatgcactt

SEQ ID NO: 1973 - DNA, 40 bp, Artificial Sequence
  Affymetrix ID 2359042
ccaagttctcatcttcagcatcgcagtttcgttctccacc

SEQ ID NO: 1974 - DNA, 91 bp, Artificial Sequence
  Affymetrix ID 2437704
ttccattctattactcttaggtttgtatctcatggaattcactttaacctctgcctcgtgttatttgctttagctgtacattatgctctta

SEQ ID NO: 1975 - DNA, 33 bp, Artificial Sequence
  Affymetrix ID 2778373
cccaaaacatagatccgaacaccagctttgccc

SEQ ID NO: 1976 - DNA, 46 bp, Artificial Sequence
  Affymetrix ID 2954503
atttcctacactgttgatggtggcaatgacaaaatcaattgcagtg

SEQ ID NO: 1977 - DNA, 25 bp, Artificial Sequence
  Affymetrix ID 2441001
ctggagaaatggctatgggtgactg

SEQ ID NO: 1978 - DNA, 59 bp, Artificial Sequence
  Affymetrix ID 3162378
gaattagttcctcagcccagtgtaagactggattaaaaatcgtgcatggatgtgcaggg

SEQ ID NO: 1979 - DNA, 46 bp, Artificial Sequence
  Affymetrix ID 3199012
cacccagtcagtcagagtcagagccagagaaggctccattgtgcag

SEQ ID NO: 1980 - DNA, 64 bp, Artificial Sequence
  Affymetrix ID 3449682
aagggtgtggcacattgctggtgttttcagggaagaaagcagaacgtctgtgggcaagcagtgg

SEQ ID NO: 1981 - DNA, 515 bp, Artificial Sequence
  Affymetrix ID 3687337
ggagatccttgtgtagcggcagaaagtttagcaacactgtctcctgcattagtgtggagggtaggaaatatacctaaggaacggatggtctagctaaggagctttccagacagaatgttgaaggtgccacctggcttcttgctgcttatagtaaaactgaagaggagagagtaagttaaagaaaaaaaacacttaaatgaaaaagagcctgaaattgttgggtttgaaaattcccagcctttccagataacaagtgatgttaaaattaacaaatggcttccgtgcaaagattaaatacaaggcattaaatacagggaaatgtggtctaaaggtcaagctgaggatgtgatgaaaaagtcctttgttaagacctcagaaataccaacaagatgcctcagaggggacttccagtcgaatgaaataataatcacgcttctgagaaggttaaaggtgttgtctttcagcgtctcagcacaagcccaaagtagagaagggcttaccttgcagagattttc

SEQ ID NO: 1982 - DNA, 25 bp, Artificial Sequence
  Affymetrix ID 2333554
cctacccttggcagtgtggcagtga

SEQ ID NO: 1983 - DNA, 42 bp, Artificial Sequence
  Affymetrix ID 2570354
gtgttacttccaccatggtgccacacacttaatatccattcc

SEQ ID NO: 1984 - DNA, 130 bp, Artificial Sequence
  Affymetrix ID 2873144
ggggcttctctatgcccggaaactgcctcatcaactgaaacaaatcctgaatcatcaaagggccaaacccactgccacctttagacggagcaggagagttaccctggctctgtcactgccactaagtcta

SEQ ID NO: 1985 - DNA, 123 bp, Artificial Sequence
  Affymetrix ID 3409485
tgaataggcagctagtacatgaacctggcattaggggtttggggctggcatacttaaacatgtggctagatgtgatcaccttcagagtaaatgtaaatagtatcatccctccttatctgtatc

SEQ ID NO: 1986 - DNA, 27 bp, Artificial Sequence
  Affymetrix ID 3476542
gtgtgttccaggcgatggcaggaggga

SEQ ID NO: 1987 - DNA, 227 bp, Artificial Sequence
  Affymetrix ID 3620299
atgacagtttttctctaggctaataactcaatgagcagaaaggaaagtcctcccttttaaatgtatatgaatgtatatgtagttcacacttacactctgacacagatctcattgtgtccaatgatgtgtgtgtgtgtgtgtgtgtgtgtgtctccaagactgagacacatgtactaaagagtgatactggccacatctactctgggcttggagggtaacttcagcaa

SEQ ID NO: 1988 - DNA, 29 bp, Artificial Sequence
  Affymetrix ID 3626913
tgcaacctcgacctgcttggcttaagcaa

SEQ ID NO: 1989 - DNA, 203 bp, Artificial Sequence
  Affymetrix ID 2699759
ccatcatgagctgaccaacaatttctaaattcctactcagaaacacagcaaggggaatgcagtcaagcacaaagggcttaaatgaccagataaggctgggctggatgaataaagaggaatatcctatgaatgtgactgtgtagttttagagtatcccgattcaactgttatatttgacttgtggccttgtagacagtgtgtta

SEQ ID NO: 1990 - DNA, 247 bp, Artificial Sequence
  Affymetrix ID 2737582
tagccaagtgcagagggtgtctccgggtgtgtgcgtggcccacaagagggcaagaagagagaaggcggggataggagggaagagggtgggggtgagaggcagccctgagagggcggaggaaggaagaggctgggagctcggcgcccgcggcgcagctgccgtcgctgccgcagctgtccagggaggatcgccaaaacggcgacgaataaacaacttaccttgcggagaagagctacgactgcgatgc

SEQ ID NO: 1991 - DNA, 73 bp, Artificial Sequence
  Affymetrix ID 2964449
cccgatggaatatgcaggctctggacatgattagaaatttgatggactttgacccacaaacggaccagcctga

SEQ ID NO: 1992 - DNA, 25 bp, Artificial Sequence
  Affymetrix ID 3695220
ggagctgccttgatttacacatcag

SEQ ID NO: 1993 - DNA, 26 bp, Artificial Sequence
  Affymetrix ID 2939888
taaagaatatctcctccaggtgtggt

SEQ ID NO: 1994 - DNA, 61 bp, Artificial Sequence
  Affymetrix ID 3632627
atggagatctacactgacaccctcagtcctagaggcagagaagaggttcagatctggcctg

SEQ ID NO: 1995 - DNA, 110 bp, Artificial Sequence
  Affymetrix ID 3695228
cacgcgctgcaacgtgtggattctggatggagacttgtaccacaaaggcctgctgaaatttgcagtttctgctgaatccttgccagagaccctcgtcatttttgttgcag

SEQ ID NO: 1996 - DNA, 77 bp, Artificial Sequence
  Affymetrix ID 3854016
tagatctcgtcgctggtatgcttggttccgctcctcgtttcttagttgcttattctacccgttattcactgatgtta

SEQ ID NO: 1997 - DNA, 205 bp, Artificial Sequence
  Affymetrix ID 3980369
tccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtc

SEQ ID NO: 1998 - DNA, 84 bp, Artificial Sequence
  Affymetrix ID 3799919
tgtattacacagagactaccgcacaaaacacggacccaatgccaggcaagcacgcgcccagcctgaacctccaagaactgtctt

SEQ ID NO: 1999 - DNA, 28 bp, Artificial Sequence
  Affymetrix ID 3032425
cacacctgtaagctgaggtgaaggagtt

SEQ ID NO: 2000 - DNA, 83 bp, Artificial Sequence
  Affymetrix ID 2475245
aaagaaagctaaataccagtatggtggactgaattctggacgtcctgtcactccacctcgaacagctaatccgccgaagaaaa

SEQ ID NO: 2001 - DNA, 43 bp, Artificial Sequence
  Affymetrix ID 3487169
tctggggataccgaaagtgggtcatgtgaagcgaattctccag

SEQ ID NO: 2002 - DNA, 30 bp, Artificial Sequence
  Affymetrix ID 3955155
aatgacatcccttttgagctgtggatggtg

SEQ ID NO: 2003 - DNA, 324 bp, Artificial Sequence
  Affymetrix ID 2827160
cacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaatta

SEQ ID NO: 2004 - DNA, 323 bp, Artificial Sequence
  Affymetrix ID 3186892
atagataacgtttgtgtggcactccccaagactcaggcattgtgataactaacactttccatgaataatgtcatagaattctcacaaacatcctgtgagatagacactattattttcaaccccatgtacatatgagaatactgagagttggagagactgagtaacatgccctagatgactcagctagcaaggaatgaaaagcacattctaactccacccacatatatagttccaggatcccatctctctacctcacattaattagttctataccagctttatgtttcctactagaatgtgcatgttttaaaggctgagctttc

SEQ ID NO: 2005 - DNA, 85 bp, Artificial Sequence
  Affymetrix ID 3195536
tggccttctggacagtaggtaggcatgtgatcactgttgtcactaaacctgggaaatgattcctgggtcagggttcattaattgc

SEQ ID NO: 2006 - DNA, 264 bp, Artificial Sequence
  Affymetrix ID 3238305
gtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgaga

SEQ ID NO: 2007 - DNA, 371 bp, Artificial Sequence
  Affymetrix ID 3744218
acttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttttagaccccccatattatcccagtgtcccctgcccccctcttcccccaccccatgcccccaattctgtggcgcatccagattgtgaaaatgta

SEQ ID NO: 2008 - DNA, 69 bp, Artificial Sequence
  Affymetrix ID 3810033
gtgaatatatctaggtccagcagggtctcagaagcagatgccaacctgaggggaatatttaccagatga

SEQ ID NO: 2009 - DNA, 217 bp, Artificial Sequence
  Affymetrix ID 3943786
cagcagctgctatccatcgtcatcaccagtgtcatcatcgccatccccatcatcaccaccaacaccgccacccccccagcgacacactagctgtggacacatcctttacgcccttgaacctgagtttctacagctatgaagcaagtcccatggaatttacagaccaaacgctaagtgtagggctccctgggagctggtcttatggagcacactggca

SEQ ID NO: 2010 - DNA, 294 bp, Artificial Sequence
  Affymetrix ID 2321472
cagtccatgaggtccacttgtctaaatatgtcacttgaagtgcaaggtaccaattgctcagtggctcaaaatgattttctggttctgttgtcatttcaagagcttctcttgagggttgagagagtctgttttcctaagaatctggttctctccatcagtctctgtttccaccttatcttcctgggaaggtgtgctttctttgaggtgagatgtgaagcctgcccacgtgcagttttatgtcgaattccaagtcagatcttaacttggtactcccggagcctgttggaagtctta

SEQ ID NO: 2011 - DNA, 145 bp, Artificial Sequence
  Affymetrix ID 2361272
gtgcaacatcactttgacttgattattcttgggtctgttttatttcccgcttttattttgcttttgaaatctttttccttggtggatttgtacgtgtcttcactagatgcctcaaattaagtctgaccacaatcctactctactt

SEQ ID NO: 2012 - DNA, 35 bp, Artificial Sequence
  Affymetrix ID 2447714
tgccaacttctcttcaccacacaatctgcagaagc

SEQ ID NO: 2013 - DNA, 220 bp, Artificial Sequence
  Affymetrix ID 3175671
tatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatata

SEQ ID NO: 2014 - DNA, 35 bp, Artificial Sequence
  Affymetrix ID 3517776
tataaggacttcacagatagctgccgtggatgctg

SEQ ID NO: 2015 - DNA, 88 bp, Artificial Sequence
  Affymetrix ID 3626941
taatttcacaatgggtgtgggaggttggtgagtagatggactagattcaaaagtagatacctcgctctcacctatagcctagcagttt

SEQ ID NO: 2016 - DNA, 29 bp, Artificial Sequence
  Affymetrix ID 2467805
ctccaacacactacgtcagaaggacccgg

SEQ ID NO: 2017 - DNA, 53 bp, Artificial Sequence
  Affymetrix ID 3701421
ttgctttgtcttgtgatcgcagctcacggcagccttggactcgtgggcacgag

SEQ ID NO: 2018 - DNA, 27 bp, Artificial Sequence
  Affymetrix ID 3717066
cagaaagtgctgcaattgcctgtgtca

SEQ ID NO: 2019 - DNA, 28 bp, Artificial Sequence
  Affymetrix ID 2476534
agatggtacaaaggtcgtgatagggctg

SEQ ID NO: 2020 - DNA, 26 bp, Artificial Sequence
  Affymetrix ID 2750682
ccaagattaggccactgccctgtaac

SEQ ID NO: 2021 - DNA, 206 bp, Artificial Sequence
  Affymetrix ID 2412205
gggttaagctgggaaccatgtctcctggggcaaaattttaattcttctagccacttgttatgtgatctcaagcaaggtacatacgtctctgggtctttttttctttatctaaaatatgaagagattaagtgttttcttaattttctttcagctctgatattatgtgattctgtgattaaatgacctggatgttgataatacatgcc

SEQ ID NO: 2022 - DNA, 322 bp, Artificial Sequence
  Affymetrix ID 3019902
ctttggagttttcgcccagatcagaattttattgccttttgccgtagactgctgcaagatttccagagcaaagagaaggtatagtgttccttaatgtgagttatgaagatcaaaatacagcaaagagaagatttcagagatttaaaagtgataatttttactgaaatttggaaatatgtctccatattttaactttattttataaaaaagaattactctgttttttgaaatggccaagcattaagtaatatatgaccgtgaatttcttgagggtgggaaatgtgactggattttatatttcgattgtatcacatgcagcctc

SEQ ID NO: 2023 - DNA, 79 bp, Artificial Sequence
  Affymetrix ID 3750928
acactatgtggcattgtgctttggagaagtgcgtatcagaacggacctacagaaagtttctgacctgtctgccccattc

SEQ ID NO: 2024 - DNA, 34 bp, Artificial Sequence
  Affymetrix ID 2511032
atgactgagtcttatagcggtgttgggcatagca

SEQ ID NO: 2025 - DNA, 35 bp, Artificial Sequence
  Affymetrix ID 2568632
atcctttgtcccgattgggtcccagatacacaaaa

SEQ ID NO: 2026 - DNA, 28 bp, Artificial Sequence
  Affymetrix ID 3039827
gagtccttcctggatagcagcaccaaag

SEQ ID NO: 2027 - DNA, 25 bp, Artificial Sequence
  Affymetrix ID 2437284
cagctgccaccggttggagggctgg

SEQ ID NO: 2028 - DNA, 492 bp, Artificial Sequence
  Affymetrix ID 3076362
gcatacaagtctgcccagtcccaggaagaaagaggagagaccctgaattctgaccttttgatggtcaggcatgatggaaagaaactgctgctacagcttgggagatttgctatggaaagtctgccagtcaactttgcccttctaaccaccagatcaatttgtggctgatcatctgatggggcagtttcaatcaccaagcatcgttctctttcctgttctggaattttgttttggagctctttcccctagtgaccaccagttagtttctgagggatggaacaaaaatgcagcttgccctttctatgtggtgcgtgttcaggccttgacagattttatcaaaaggaaactattttatttaaatggaggctgagtggtgagtagatgtgtcttggtatggaggaaaagggcatgctgcatcttcttcctgacctccggggtctctggccttttgtttccttgctcactgaggggtctgtctaaccaagcaggcta

SEQ ID NO: 2029 - DNA, 122 bp, Artificial Sequence
  Affymetrix ID 3527927
tgagtcagcatccccaatttctaccacatccagcactcctaccatcttgcatgtaccttccttcctgtccccggctacttgggagtcagcttcttccctctcccaactcatctccctcttct

SEQ ID NO: 2030 - DNA, 163 bp, Artificial Sequence
  Affymetrix ID 3889598
caggtcttagcggtcatcaggatgaaggcggtgggaagtggagcaacagagatccaaatatggaaagagcacgtgctgataccagaggcactggaaataatagcaatatccgaaagtctgctcaccctgcgtcattccttcagacagtagtcgggctctattc

SEQ ID NO: 2031 - DNA, 149 bp, Artificial Sequence
  Affymetrix ID 3735624
ttaaaatctgcaatactggccaatattcttttatcaaacaggagaccgcagctttaaagggggaaaatgcagacgttggataaaaacagcaagaaatagtcattttcattaataggtctcaaacagtttacgaaacagccattattatc

SEQ ID NO: 2032 - DNA, 105 bp, Artificial Sequence
  Affymetrix ID 2739508
ggcatgtgtgggtaattagttctcactatggttagactcctgaagtgagtggtccaagttgttagcgtgcttctgctctgtgaggccaggccagtatcctgtctg

SEQ ID NO: 2033 - DNA, 78 bp, Artificial Sequence
  Affymetrix ID 3819517
gacatcgccaagcacctgacctatgagaacgtggagcgctggctgaaggagctgcgggaccacgcagacagcaacatc

SEQ ID NO: 2034 - DNA, 163 bp, Artificial Sequence
  Affymetrix ID 3330082
ggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgta

SEQ ID NO: 2035 - DNA, 118 bp, Artificial Sequence
  Affymetrix ID 3378442
ggccacattctcctaatagcatgaaacagtcagctcactttctgcctcctcctcttacacttccctgctgtccactgcggccaactcagcacagtgtccttgaagctgattgagggtc

SEQ ID NO: 2036 - DNA, 180 bp, Artificial Sequence
  Affymetrix ID 2473789
gcgcgggctttcgagcacatacaaacctgattacaaaagtcagatttctttatttcgtcttgggcacgtcattttaaccccgctcagcctctcttttgtgtatgaaactgaaagtaatagcttctgctgtgcaaaatgattagaggaatttgtgaagcgcttggcaacatactaggaccc

SEQ ID NO: 2037 - DNA, 399 bp, Artificial Sequence
  Affymetrix ID 3115627
ttgagatttatgtgtgtgccagacacacacacacacacatatgtacacaagcaatttttgtgtgtgtggctcaagccaggcagagaaagacaaatactaaatgatctcactcatatgtgaaatctaaaaaagttgatctcaaagaagtagaaaggagcctggtggttatcagagtctggggagggggttggggagatattggccaaaggatatacaatttcagttaggtaggaggaataagttcaagaagtcgattttgactatagttaataatgtgttgtattcatgaacaaggctaagagagtggatgtaaagtgttcttaccacaaaaaggataactacatgaggtaatgcacatgttaattagctagatttagtaattccataatgtatccactg

SEQ ID NO: 2038 - DNA, 63 bp, Artificial Sequence
  Affymetrix ID 2745189
tccatttctttttactgcgtccgtccctgacaatacctgctgtttactcagcccttaacgttg

SEQ ID NO: 2039 - DNA, 27 bp, Artificial Sequence
  Affymetrix ID 3450260
aaagtgatacatttgtgagggaggagg

SEQ ID NO: 2040 - DNA, 141 bp, Artificial Sequence
  Affymetrix ID 2656876
cagaccttatctcatagggtgattatgagcattagatgaaatcgtgggtgaaaggctcagtacagtgccaggtatacaagaagcattcagttaagtaatagctgttattgttataactgaggttttcacaagccgcacact

SEQ ID NO: 2041 - DNA, 315 bp, Artificial Sequence
  Affymetrix ID 2952697
gctagtttcaaagactgcgaccctgttttgaattggcttgtttatgttgcgacggtggctggaagccaggccaacccagggtcagctttcccaaatcagtcgccaaggcccacgagaacagtagtttcagaactcccagaaataggttcaaagatgcctgtcctgtaccagtcctgcccagcctcgtttttccttaccaccctgactgcagtcttaactcctgcaaactaatttgatcgctctaagtttaaccgcgcccagaatttcacttttgcttgcttggcctttgctgtgggtcacaacagcccttcttgc

SEQ ID NO: 2042 - DNA, 834 bp, Artificial Sequence
  Affymetrix ID 3579549
cctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctca

SEQ ID NO: 2043 - DNA, 27 bp, Artificial Sequence
  Affymetrix ID 3703035
cgatggacactgatgcccacacaggtg

SEQ ID NO: 2044 - DNA, 1294 bp, Artificial Sequence
  Affymetrix ID 2444562
tccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaat

SEQ ID NO: 2045 - DNA, 87 bp, Artificial Sequence
  Affymetrix ID 3816284
ccaggtcgtgctccaggttgctgctgccaccaactgcaaacatcactatggcgtcgagaaagcagacatcccggccaagtatgcgga

SEQ ID NO: 2046 - DNA, 25 bp, Artificial Sequence
  Affymetrix ID 3231694
atccaccaagcagtgcgtccaggtg

SEQ ID NO: 2047 - DNA, 30 bp, Artificial Sequence
  Affymetrix ID 3760111
gaatgaacgcagagagtgtcagtgctgaca

SEQ ID NO: 2048 - DNA, 31 bp, Artificial Sequence
  Affymetrix ID 3960937
caggcacaccgccttgaggtgggcagtgccc

SEQ ID NO: 2049 - DNA, 37 bp, Artificial Sequence
  Affymetrix ID 2519659
gaaagattcattggcatgccacaggggattctcctcc

SEQ ID NO: 2050 - DNA, 194 bp, Artificial Sequence
  Affymetrix ID 3380965
tctaacccttgagacactgccaacatccctcctagtacaagacttttcttggtgcttgctgtttttagaggagttttggcccttcagtgtttgtaaagctctcggatcctcagaaaaaaattctttagtgattaattttgaaattggagctgtttgattattttgattaagaagctgattttcggcctggcacg

SEQ ID NO: 2051 - DNA, 111 bp, Artificial Sequence
  Affymetrix ID 3690096
agatgggaatgatttgcacatgacatataaaataggacttgttgaagctctatgtggatttcagttcacatttaagcaccttgatggacgtcagattgtggtgaaataccc

SEQ ID NO: 2052 - DNA, 30 bp, Artificial Sequence
  Affymetrix ID 3777917
aggatcctgccgaaaggtgctcagtggcct

SEQ ID NO: 2053 - DNA, 29 bp, Artificial Sequence
  Affymetrix ID 3811929
atgtatcattctccatacacctgtgcctt

SEQ ID NO: 2054 - DNA, 29 bp, Artificial Sequence
  Affymetrix ID 2436400
ccagccacgcgtccagcaggtcagggatt

SEQ ID NO: 2055 - DNA, 56 bp, Artificial Sequence
  Affymetrix ID 3868616
tacatcattaaggagaagacagtcttgctgcagaagaaggacagtgaggggtttgg

SEQ ID NO: 2056 - DNA, 163 bp, Artificial Sequence
  Affymetrix ID 2833315
atcttttgattgctagcccagctgctttccttgttatcactttgtggagcaggctggacattgacaatgagttctgagactgagtggaatgggagacccctcccagctggtggtcgagctgcctagagcatggtccatctgtttgggactagggttgagctcc

SEQ ID NO: 2057 - DNA, 73 bp, Artificial Sequence
  Affymetrix ID 2886091
tgacgaatttcgtctttcttccctacggtggagtcagtgttaaacatacaacaaggagttctggggcacaggc

SEQ ID NO: 2058 - DNA, 66 bp, Artificial Sequence
  Affymetrix ID 3146585
atgtccacgatgtgctgcttatataataaagatgaatgatgggagctgcaatcacatgacatgtgc

SEQ ID NO: 2059 - DNA, 28 bp, Artificial Sequence
  Affymetrix ID 3271059
gtgagatacttgacatggggacctttac

SEQ ID NO: 2060 - DNA, 25 bp, Artificial Sequence
  Affymetrix ID 3589673
ttcaagaagttctggggacagaggg

SEQ ID NO: 2061 - DNA, 161 bp, Artificial Sequence
  Affymetrix ID 3971336
tccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtg

SEQ ID NO: 2062 - DNA, 194 bp, Artificial Sequence
  Affymetrix ID 3304025
gtatgtgataagtatttggatttgagagtagacctttcatagtgaggcttatcaggttgaggggaggtgatgactggaaatatatttatttattttaaatcccactttggctttagtaaaatctgaatatgtgtgcatttctagtttcttacaccaaatgtaggttccgtaagttcatgcaagtacagtgggtc

SEQ ID NO: 2063 - DNA, 59 bp, Artificial Sequence
  Affymetrix ID 3350758
agacaaagagcctgatgtactgttcgtgggagactccatggtgcagttaatgcagcaat

SEQ ID NO: 2064 - DNA, 171 bp, Artificial Sequence
  Affymetrix ID 3921733
cagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatga

SEQ ID NO: 2065 - DNA, 25 bp, Artificial Sequence
  Affymetrix ID 2361637
acaggagccaatgcccaatcatagc

SEQ ID NO: 2066 - DNA, 140 bp, Artificial Sequence
  Affymetrix ID 2625412
accacctgggtattgaagccctataaaaacactttctacttaccttaatatagtctggcgttgctgggacctcacagtgttctttcacactttttatgtaacttaggaactgaaataccactcatgcatttgttctaaag

SEQ ID NO: 2067 - DNA, 124 bp, Artificial Sequence
  Affymetrix ID 2737704
gattgctatggaagtactgagtccctgaaggagagacaaggtgcaggaagccccaatcgccaggccatcgatgaaattgtggagggcatcgcagagcgttatcatccaggcaatcgtccctatt

SEQ ID NO: 2068 - DNA, 25 bp, Artificial Sequence
  Affymetrix ID 2795252
gttcggatgatttcacgggagcagc

SEQ ID NO: 2069 - DNA, 34 bp, Artificial Sequence
  Affymetrix ID 3203541
gctgtgacctttgctaactgtgcgctgggccgcg

SEQ ID NO: 2070 - DNA, 130 bp, Artificial Sequence
  Affymetrix ID 3510917
aagaccagggtaatcatagaactgccaagcagaaagaaatgtagaatgtagcagtggtgtggagacccgtggctgacaggtggtggtcttcatataggctgagggacaggctagatgcatgtcaagtggc

SEQ ID NO: 2071 - DNA, 159 bp, Artificial Sequence
  Affymetrix ID 3670551
gagctccagggatatctcttctgcacattcttccagagcagtgcatctctcttctggttgtttgtacacccttcttttactctccttattatcctctcccatgttcattcagtacatacttagtgagtgttcaccagatgcttagcacctggggtatac

SEQ ID NO: 2072 - DNA, 387 bp, Artificial Sequence
  Affymetrix ID 3729159
gcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacact

SEQ ID NO: 2073 - DNA, 55 bp, Artificial Sequence
  Affymetrix ID 2969482
tgtatttgccggctgccagattccataccccaaacgagaattccttaatgaagat

SEQ ID NO: 2074 - DNA, 74 bp, Artificial Sequence
  Affymetrix ID 3040116
tggcaaccttattttactacacgcattgtagatgactttggcacacacttacgagtattcagaaaggctcaaca

SEQ ID NO: 2075 - DNA, 25 bp, Artificial Sequence
  Affymetrix ID 3819122
gaggtggctagaaaacggcaagaac

SEQ ID NO: 2076 - DNA, 172 bp, Artificial Sequence
  Affymetrix ID 2359763
acctgcgtcacaccctggctagtgacccagtcagacgtgctggggaccctggctgaccacctgtaccaggggcaaggaaggaaggagaggggagcattgtgaagcagggcaggatgactcttgaaggtggagacaggccctggacagctctgggacccttaatggtggcagc

SEQ ID NO: 2077 - DNA, 56 bp, Artificial Sequence
  Affymetrix ID 2969302
ggtttgatagaaaatcgccctcagtcaccagctacaggcagaacacctgtgtttgt

SEQ ID NO: 2078 - DNA, 38 bp, Artificial Sequence
  Affymetrix ID 2330410
gaagctggtcccacggaaagtggtatctcgggaatcag

SEQ ID NO: 2079 - DNA, 449 bp, Artificial Sequence
  Affymetrix ID 3265461
tctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactac

SEQ ID NO: 2080 - DNA, 27 bp, Artificial Sequence
  Affymetrix ID 3735093
gccaccgacttcgtgcaggagatgcgc

SEQ ID NO: 2081 - DNA, 63 bp, Artificial Sequence
  Affymetrix ID 2402500
ggcaacattgacatgagccgtgtggctgtgatgggacattcatttggaggggccacagctatt

SEQ ID NO: 2082 - DNA, 52 bp, Artificial Sequence
  Affymetrix ID 3552152
tcttcaacccactgcttcctgactcgctctactccgtggaagcacgctcaca

SEQ ID NO: 2083 - DNA, 216 bp, Artificial Sequence
  Affymetrix ID 2736402
attataaggtatgatatggcttcccaattgtcaaagaattaaaatgctcattaggagaggagtgactgcttctccctttagtagaaaaacaattcaaactcaggttaccaattacaatacacaaactaaaacagttatgttgagccgggaaaccgtcttcttgtaggctatcttctagcaccaaataatgcccacatgatttctggctgaaggcca

SEQ ID NO: 2084 - DNA, 340 bp, Artificial Sequence
  Affymetrix ID 2751960
gcttccttcgtgaattctaaccgtaccgttactgtgtttgaggatcactggcagccgagctctgagtggggaactgagataagaaaggtgttgtcatgataacacctggacagctgcatcccacagactatgggagtgccaggaaactggctacctcacagcagagtagagaaaatggaaataaacacaaatataagcttttcagtgagctgtgggtcagagaaggccacaagtggtctggcagatcatggtgcagctctttgtttcatgagctacgtgcagcagtagtttttatgagctctttttgtagctttccagccctaggattcagccatggtaa

SEQ ID NO: 2085 - DNA, 85 bp, Artificial Sequence
  Affymetrix ID 3024231
tgcccagaaacgaccattttggacaatctcatccagttttacgcttgttttattcagaaagagaatcacctatcctcttcacatc

SEQ ID NO: 2086 - DNA, 97 bp, Artificial Sequence
  Affymetrix ID 2928814
taaggaaattgggttgtcaccactggctttgagtaattcgttttgtctatgcaagctgtcttcatacgaaaaaggttttcatactatatccagtccc

SEQ ID NO: 2087 - DNA, 28 bp, Artificial Sequence
  Affymetrix ID 3166955
gttgaagtcgaaacatcccactggacat

SEQ ID NO: 2088 - DNA, 96 bp, Artificial Sequence
  Affymetrix ID 3829651
cctgactgtggtgcaagtccatttccagtttttgactcatgcgttacagaaggtccagccggtggctcactcttgctttgctgaggtcatcgtgcc

SEQ ID NO: 2089 - DNA, 28 bp, Artificial Sequence
  Affymetrix ID 3709186
gtcaggcagctgtaagcggcgacagaag

SEQ ID NO: 2090 - DNA, 26 bp, Artificial Sequence
  Affymetrix ID 2947628
ctgttgacttcagagtcgagtgtgag

SEQ ID NO: 2091 - DNA, 184 bp, Artificial Sequence
  Affymetrix ID 3820638
cccagtgatggccacgtcttgtttctagaatcccttcctttgcacaagccatattctgaactcttaattccttcccttaacttcaatccctatgtctcctgtcctacctcatggttttcctggccccacacctgatgctcagagcccactgtgaacccctggtgcctctttttggactcggttc

SEQ ID NO: 2092 - DNA, 116 bp, Artificial Sequence
  Affymetrix ID 3823661
cagcctcagactttttcccactgagggtccagagagcggggccacgtgtcacccacgtctgcgcttggtcacccgtcctccccaccctgtgtgtgtttatgtcatagttacattaa

SEQ ID NO: 2093 - DNA, 30 bp, Artificial Sequence
  Affymetrix ID 4038647
aggtctccgctttcctggaaatccagaccc

SEQ ID NO: 2094 - DNA, 32 bp, Artificial Sequence
  Affymetrix ID 2543897
agctctgggtgagacttgtcttccgggggctg

SEQ ID NO: 2095 - DNA, 281 bp, Artificial Sequence
  Affymetrix ID 2353902
ctctgattaggtcttgtgcccattgttgaaccaaatgctgtgcttaggaggatgggacatgttctttttgttttgcttagttagggcctggctctggagccaggagaggggaggaggaaatgttgctggatgtaagttagcactgatactaattattctaacaatgattaatagttagaatggctgggtgcagtggcacatagtcccagctccgcaggaggttgagatgggaggatcgcctggggccaggagtccaaggctatggggcaccatgatcatga

SEQ ID NO: 2096 - DNA, 43 bp, Artificial Sequence
  Affymetrix ID 3190953
cactttgtggatgagaaggccgtgaatgagaaccacaaggact

SEQ ID NO: 2097 - DNA, 26 bp, Artificial Sequence
  Affymetrix ID 3922999
gcgcccggccgagaatgacatcttaa

SEQ ID NO: 2098 - DNA, 165 bp, Artificial Sequence
  Affymetrix ID 3701615
atggacagcttcaaagggcagtttgggggtttctgtttattttcctgtatgttctggtcacctcaatcatctaaccagaagaactggcccaaaattaggcacaagaaaaaaggaaaaagtctagccctgccacataactcctggaactggttgcagaaactgaac

SEQ ID NO: 2099 - DNA, 25 bp, Artificial Sequence
  Affymetrix ID 2528729
gggaagacacgaagggagggcgctg

SEQ ID NO: 2100 - DNA, 29 bp, Artificial Sequence
  Affymetrix ID 3188305
ggatagcttctattgtggacgtggaatcc

SEQ ID NO: 2101 - DNA, 81 bp, Artificial Sequence
  Affymetrix ID 3578798
agatctactcctggatgcgggtacaggacagcatccccagactgtttgtaaagtctcatgtgatacatggagggcaggcct

SEQ ID NO: 2102 - DNA, 155 bp, Artificial Sequence
  Affymetrix ID 3810041
agcagaagcaaacgggggtgtctcaggagggggccccgtttccttcttgtaaagctgctcccacccacagccacactccattcagtcaggtttatgtgctgttcttccttgtcccttatgaggtagaaccatcaccttgcgtgcaaagcagctta

SEQ ID NO: 2103 - DNA, 30 bp, Artificial Sequence
  Affymetrix ID 2520084
ggtgtctgtcggtctttgcttgtcagctgt

SEQ ID NO: 2104 - DNA, 80 bp, Artificial Sequence
  Affymetrix ID 2615285
gtgtttgtgctcaatgtaagagcaaggaaggtgcgggaagatgagggggatgaggcgcaggagtacagggctgttattca

SEQ ID NO: 2105 - DNA, 38 bp, Artificial Sequence
  Affymetrix ID 2676383
tggtagagtggtttgtacagatcgccatggctttgcag

SEQ ID NO: 2106 - DNA, 27 bp, Artificial Sequence
  Affymetrix ID 3337536
aggcttcttgcacaggcagaaggggct

SEQ ID NO: 2107 - DNA, 110 bp, Artificial Sequence
  Affymetrix ID 3670582
tacgtgcccaagaatcaatccaatccaactgataacattttctctgaagatagctgcctcttcaaatactggtacagagattcaagaagctgtaccacagaccatcagtt

SEQ ID NO: 2108 - DNA, 40 bp, Artificial Sequence
  Affymetrix ID 2359853
cccatttttcattaggtccaggtgtatccaaatgttgcca

SEQ ID NO: 2109 - DNA, 62 bp, Artificial Sequence
  Affymetrix ID 3349998
tgatgtggccccgattgcagaattgagttggaggctgaagcatgtgagctctgatccttgcc

SEQ ID NO: 2110 - DNA, 273 bp, Artificial Sequence
  Affymetrix ID 3431977
cttccctctggaagactaacatgtactgctgaagtcttgttcagtgtccttctagccccagactttgcagcctaccaacatggactgagacagggaaagcgtgggcaagtgagttccatactctaattttcctacagaagcatcctaagtggtgtgtgggttctcagatcaagtcacaaacacattcacagcccatgatatcgtacaacactactttttagttcaaattaattatgagtaacaacagactatctgccaaaatagggagctgca

SEQ ID NO: 2111 - DNA, 27 bp, Artificial Sequence
  Affymetrix ID 2482372
agctaggaaaataggagtggttggctg

SEQ ID NO: 2112 - DNA, 27 bp, Artificial Sequence
  Affymetrix ID 2619332
cattgcagatgccagtccaaccagcac

SEQ ID NO: 2113 - DNA, 90 bp, Artificial Sequence
  Affymetrix ID 3810037
cccgtggctctaaaagtattatccgaaatcaaccagtcacccctttcaccttctctcagtttaaaaatggatccagtgcatacccaatag

SEQ ID NO: 2114 - DNA, 319 bp, Artificial Sequence
  Affymetrix ID 2944959
gtaggaatcaaacatagcgccatctatctgctttttatattatcctacactattttaaaaactgctcaacagtcttatacagaaatctttaaaagatagacaggataacatgctatattaaccccaccattgaaataatccaacaccatcacgattccgattaagagaagaaaaaaatcttttttttttctttttttttctttttttctttttttttttccgaaaccactcgccctccactgactgcccctgtaccacatcaaacagtctcctctcctccacgcctccggggtctgggaagtctcacctcactgatttc

I claim:

1. A method for treating a subject having prostate cancer, comprising:
   (a) obtaining an expression level of at least one coding target sequence and obtaining an expression level of at least one non-coding target sequence, wherein the obtained expression level of the non-coding target sequence is distinct from the obtained expression level of the at least one coding target sequence, from a prostate cancer cell in a sample from the subject having prostate cancer; and
   (b) determining whether the prostate cancer cell of the subject comprises a recurrent prostate cancer transcript profile utilizing the expression level of the at least one coding target sequence and the expression level of the at least one non-coding target sequence in the sample; and
   (c) if the prostate cancer cell of the subject comprises the recurrent prostate cancer transcript profile as determined utilizing the expression level of the at least one coding target sequence and the expression level of the at least one non-coding target sequence in the sample, then administering a prostate cancer treatment selected from the group consisting of adjuvant chemotherapy, systemic radiation therapy, and anti-androgen therapy, or a combination thereof, to the subject, and if the prostate cancer cell of the subject does not comprise a recurrent prostate cancer transcript profile as determined utilizing the expression level of the at least one coding target sequence and the expression level of the at least one non-coding target sequence in the sample, then monitoring the subject without providing the prostate cancer treatment to the subject.

2. The method of claim 1, wherein the prostate cancer cell of the subject comprises the recurrent prostate cancer transcript profile, and the prostate cancer treatment selected from the group consisting of adjuvant chemotherapy, systemic radiation therapy, and anti-androgen therapy, or a combination thereof, is administered to the subject.

3. The method of claim 1, wherein the prostate cancer cell of the subject does not comprise the recurrent prostate cancer transcript profile, and the subject is monitored without providing the prostate cancer treatment to the subject.

4. The method of claim 1, wherein the sample is selected from the group consisting of an aspirate, a needle biopsy, a cytology pellet, a bulk tissue preparation or a section thereof obtained for example by surgery or autopsy, lymph fluid, blood, plasma, serum, tumors, and organs.

5. The method of claim 1, wherein the sample is a needle-biopsy sample or surgical resection sample that has been fixed in formalin and embedded in paraffin wax.

6. The method of claim 1, wherein the obtaining the expression level of the at least one coding target sequence and/or the expression level of the at least one non-coding target sequences comprises a method selected from the group consisting of RT-PCR, Northern blotting, ligase chain reaction, array hybridization, and a combination thereof.

7. The method of claim 1, wherein at the least one coding and the at least one non-coding target sequence is selected from SEQ ID NOs: 1-2114.

8. The method of claim 1, wherein obtaining the expression level of the at least one coding target sequence and/or the expression level of the at least one non-coding target sequence comprises amplifying the target sequences.

9. The method of claim 1, wherein obtaining the expression level of the at least one coding target sequence and/or the expression level of the at least one non-coding target sequence comprises sequencing the target sequences.

10. The method of claim 1, wherein obtaining the expression level of the at least one coding target sequence and/or the expression level of the at least one non-coding target sequence comprises extracting the target sequences from the sample.

11. The method of claim 1, wherein determining whether the prostate cancer has a recurrent prostate cancer transcript profile based on the expression level of the at least one coding target sequence and the expression level of the at least one non-coding target sequence comprises determining via a computer model or algorithm.

12. The method of claim 11, wherein the computer model or algorithm is linear.

13. The method of claim 1, wherein the non-coding target sequence is not part of an RNA molecule that is translated into protein.

14. The method of claim 1, wherein the non-coding target sequence is not associated with a gene locus.

* * * * *